(12) United States Patent
Hagedorn et al.

(10) Patent No.: US 11,286,485 B2
(45) Date of Patent: Mar. 29, 2022

(54) OLIGONUCLEOTIDES FOR MODULATING ATXN2 EXPRESSION

(71) Applicant: Hoffmann-La Roche Inc., Little Falls, NJ (US)

(72) Inventors: Peter Hagedorn, Horsholm (DK); Dennis Jul Hansen, Farum (DK); Heidi Rye Hudlebusch, Brønshøj (DK); Lykke Pedersen, Copenhagen NV (DK); Søren Vestergaard Rasmussen, Espergærde (DK); Mette Ladefoged, Birkerød (DK)

(73) Assignee: HOFFMANN-LA ROCHE INC., Little Falls, NJ (US)

( * ) Notice: Subject to any disclaimer, the term of this patent is extended or adjusted under 35 U.S.C. 154(b) by 0 days.

(21) Appl. No.: 16/840,249

(22) Filed: Apr. 3, 2020

(65) Prior Publication Data

US 2021/0024925 A1    Jan. 28, 2021

Related U.S. Application Data

(63) Continuation-in-part of application No. 16/545,823, filed on Aug. 20, 2019, now abandoned, and a continuation-in-part of application No. PCT/EP2019/064276, filed on Jun. 3, 2019, and a continuation-in-part of application No. 16/430,339, filed on Jun. 3, 2019, now Pat. No. 11,066,669, and a continuation-in-part of application No. PCT/EP2019/064274, filed on Jun. 3, 2019.

(30) Foreign Application Priority Data

| Apr. 4, 2019 | (EP) | ................................ 19167386 |
| Apr. 4, 2019 | (EP) | ................................ 19167388 |
| Apr. 4, 2019 | (EP) | ................................ 19167394 |

(51) Int. Cl.
| *C12N 15/113* | (2010.01) |
| *A61P 25/28* | (2006.01) |
| *A61K 31/7125* | (2006.01) |

(52) U.S. Cl.
CPC ........ *C12N 15/113* (2013.01); *A61K 31/7125* (2013.01); *A61P 25/28* (2018.01)

(58) Field of Classification Search
CPC ............................... C12N 15/113; A61P 25/28
See application file for complete search history.

(56) References Cited

U.S. PATENT DOCUMENTS

| 8,901,095 | B2 | 12/2014 | Corey et al. |
| 9,340,785 | B2 | 5/2016 | Corey et al. |
| 10,006,027 | B2 | 6/2018 | Bennett et al. |
| 10,308,934 | B2 | 6/2019 | Freier |
| 2004/0220132 | A1 | 11/2004 | Kaemmerer |
| 2011/0142789 | A1 | 6/2011 | Gilter et al. |
| 2011/0191912 | A1 | 8/2011 | Alexandrov et al. |
| 2017/0175113 | A1 | 6/2017 | Bennett et al. |
| 2017/0175114 | A1 | 6/2017 | Freier et al. |
| 2019/0017047 | A1 | 1/2019 | Bennett et al. |
| 2019/0365795 | A1 | 12/2019 | Hagedorn et al. |
| 2020/0024600 | A1 | 1/2020 | Hagedorn et al. |

FOREIGN PATENT DOCUMENTS

| EP | 0878543 | 11/1998 |
| EP | 1108026 | 3/2005 |
| EP | 1752536 | 2/2007 |
| EP | 2742135 | 6/2014 |
| EP | 3119888 | 1/2017 |
| WO | WO 1997/042314 | 11/1997 |
| WO | WO 1998/039352 | 9/1998 |
| WO | WO 1999/014226 | 3/1999 |
| WO | WO 00/047599 | 8/2000 |
| WO | WO 00/066604 | 11/2000 |
| WO | WO 01/023613 | 4/2001 |
| WO | WO 01/077384 | 10/2001 |
| WO | WO 02/016417 | 2/2002 |
| WO | WO 2004/046160 | 6/2004 |
| WO | WO 2004/047872 | 6/2004 |
| WO | WO 2005/089252 | 9/2005 |
| WO | WO 2007/031091 | 3/2007 |
| WO | WO 2007/090071 | 8/2007 |
| WO | WO 2007/134181 | 11/2007 |
| WO | WO 2008/049085 | 4/2008 |
| WO | WO 2008/109379 | 9/2008 |
| WO | WO 2008/109450 | 9/2008 |

(Continued)

OTHER PUBLICATIONS

Aguiar et al., "Ubiquitous expression of human SCA2 gene under the regulation of the SCA2 self promoter cause specific Purkinje cell degeneration in transgenic mice," Neuroscience Letters, Jan. 16, 2006, 392(3):202-206.

Becker et al., "Therapeutic reduction of ataxin-2 extends lifespan and reduces pathology in TDP-43 mice," Nature, Apr. 20, 2017, 544(7650):367-371.

Bergstrom, "Unnatural Nucleoside with Unusual Base Pairing Properties," Curr Prot Nucl. Acid., Jun. 1, 2009, (Supplement 37):1.4.1-1.4.32.

(Continued)

*Primary Examiner* — Brian Whiteman
(74) *Attorney, Agent, or Firm* — Fish & Richardson P.C.

(57) ABSTRACT

The present invention relates to antisense oligonucleotides that are capable of modulating expression of ATXN2 in a target cell. The oligonucleotides hybridize to ATXN2 mRNA. The present invention further relates to conjugates of the oligonucleotide and pharmaceutical compositions and methods for treatment of neurodegenerative diseases such as spinocerebellar ataxia type 2 (SCA2), amyotrophic lateral sclerosis (ALS), Alzheimer's frontotemporal dementia (FTD), parkinsonism and conditions with TDP-43 proteinopathies using the oligonucleotide.

Figure 1:
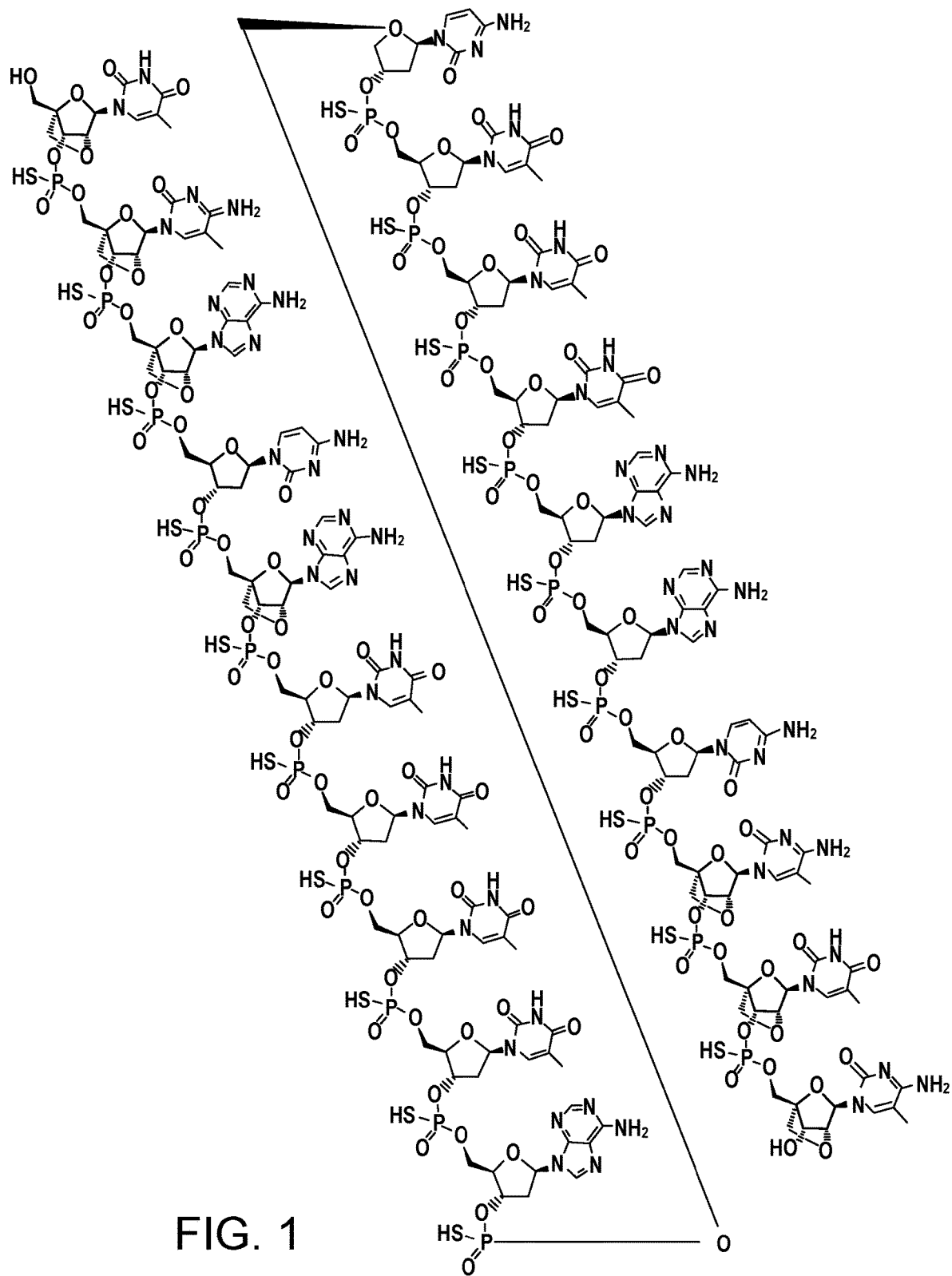

14 Claims, 8 Drawing Sheets
Specification includes a Sequence Listing.

(56) References Cited

FOREIGN PATENT DOCUMENTS

| | | |
|---|---|---|
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2010/014592 | 2/2010 |
| WO | WO 2010/036698 | 4/2010 |
| WO | WO 2010/077578 | 7/2010 |
| WO | WO 2011/005765 | 1/2011 |
| WO | WO 2011/017521 | 2/2011 |
| WO | WO 2011/156202 | 12/2011 |
| WO | WO 2012/012467 | 1/2012 |
| WO | WO 2012/065143 | 5/2012 |
| WO | WO 2012/109395 | 8/2012 |
| WO | WO 2012/143379 | 10/2012 |
| WO | WO 2013/054200 | 4/2013 |
| WO | WO 2013/067451 | 5/2013 |
| WO | WO 2013/081864 | 6/2013 |
| WO | WO 2013/120018 | 8/2013 |
| WO | WO 2013/138353 | 9/2013 |
| WO | WO 2013/154798 | 10/2013 |
| WO | WO 2014/043519 | 3/2014 |
| WO | WO 2014/052855 | 4/2014 |
| WO | WO 2014/076195 | 5/2014 |
| WO | WO 2015/002971 | 1/2015 |
| WO | WO 2015/113922 | 8/2015 |
| WO | WO 2015/143245 | 9/2015 |
| WO | WO 2015/143246 | 9/2015 |
| WO | WO 2016/036403 | 3/2016 |
| WO | WO 2016/126995 | 8/2016 |
| WO | WO 2017/117496 | 7/2017 |
| WO | WO 2018/154462 | 8/2018 |
| WO | WO 2019/233921 | 12/2019 |
| WO | WO 2019/233922 | 12/2019 |

OTHER PUBLICATIONS

Bezprozvanny et al., "Therapeutic Prospects for Spinocerebellar Ataxia Type 2 and 3," Drugs of the Future, 2009, 34(12):991-999.
Caruthers et al., "Chemical synthesis of deoxyoligonucleotides by the phosphoramidite method," Methods in Enzymology, 1987, 154:287-313.
Crunkhorn, "Ataxin 2 reduction rescues motor defects," Nature Reviews Drug Discovery, May 19, 2017, 16(6):384-385.
Davidson et al., "Expanding our Understanding of Poly glutamine Disease Through Transgenic Mice," Current Genomics, 2001, 2(13):27-39.
Deleavey and Damha, "Designing Chemically Modified Oligonucleotides for Targeted Gene Silencing," Chemistry and Biology, 2012, 19(8):937-954.
European Search Report in European U.S. Appl. No. 15/765,851, dated Jan. 18, 2018, 9 pages.
Evers et al., "Targeting Several CAG Expansion Diseases by a Single Antisense Oligonucleotide," PLoS One, Sep. 1, 2011, 6(9):e24308.
Freier & Altmann, "The ups and downs of nucleic acid duplex stability: Structure-stability studies on chemically-modified DNA:RNA duplexes," Nucl Acid Res., Nov. 1, 1997, 25(22)4429-4443.
Gao et al., "Antisense RNA Sequences Modulating the Ataxin-1 Message: Molecular Model of Gene Therapy for Spinocerebellar Ataxia Type 1, a Dominant-Acting Unstable Trinucleotide Repeat Disease," Cell Transplantation, Jul. 1, 2008, 17(7):723-734.
Hansen et al., "Entropy titration. A calorimetric method for the determination of $\Delta G°(K)$, $\Delta H°$ and $\Delta S°$," 1965, J Chem Soc Chem Commun, 3:36-38.
Heuvel et al., "Taking a risk: a therapeutic focus on ataxin-2 in amyotrophic lateral sclerosis?," Trends in Molecular Medicine, 2014, 20(1):25-35.
Hirao et al., "Natural versus artificial creation of base pairs in DNA: origin of nucleobases from the perspectives of unnatural base pair studies," Accounts of Chem Res., Dec. 18, 2012, 45(12):2055-2062.
Holdgate et al., "Measurements of binding thermodynamics in drug discovery," Nov. 15, 2005, Drug Discov Today, 10(22):1543-1550.
Huynh et al., "Dissociated Fear and Spatial Learning in Mice with Deficiency of Ataxin-2," PLoS One, Jul. 20, 2009, 4(7):e6235.
International Search Report and Written Opinion in International Application No. PCT/EP2019/064276, dated Aug. 19, 2019, 11 pages.
Kiehl et al., "Generation and characterization of Sca2 (ataxin-2) knockout mice," Biochemical and Biophysical Research Communications, Jan. 6, 2006, 339:17-24.
La Spada, "Antisense oligonucleotide knock-down of ataxin-7 in a SCA7 mouse model," NIH Grant 2013, 2013, 4 pages.
La Spada, "Between bedside and bench; Getting a handle on Huntington's disease: Silencing neurodegeneration," Nature Medicine, Mar. 1, 2009, 15(3):252-253.
Langer "New methods of drug delivery," Science, 1990, 249(4976):1527-1533.
Lim and Diaz-Nido, "Gene Therapy Approaches to Ataxias," Current Gene Therapy, 2009, 9:1-8.
McBride et al., "Artificial miRNAs mitigate shRNA-mediated toxicity in the brain: Implications for the therapeutic development of RNAi," PNAS, Apr. 15, 2008, 105(15):5868-5873.
McTigue et al., "Sequence-dependent thermodynamic parameters for locked nucleic acid (LNA)-DNA duplex formation," BioChem., May 11, 2004, 43(18):5388-5405.
Mergny and Lacroix, "Analysis of thermal melting curves," Oligonucleotides, 2003, 13(16):515-537.
Mitsuoka et al.,"A bridged nucleic acid, 2',4'-BNA COC: synthesis of fully modified oligonucleotides bearing thymine, 5-methylcytosine, adenine and guanine 2',4'-BNA COC monomers and RNA-selective nucleic-acid recognition" Nucleic Acids Research, Mar. 2009, 37(4):1225-1238.
Morita et al., "2'—O,4'—C-ethylene-bridged nucleic acids (ENA): highly nuclease-resistant and thermodynamically stable oligonucleotides for antisense drug," Bioorganic & Med Chem Lett., Jan. 7, 2002, 12(1):73-76.
NCBI Reference No. NM_002973.3, "*Homo sapiens* ataxin 2 (ATXN2), transcript variant 1, mRNA," Feb. 21, 2019, 8 pages.
NCBI Reference No. NM_009125.2, "*Mus musculus* ataxin 2 (Atxn2), transcript variant 1, mRNA," Aug. 26, 2020, 7 pages.
NCBI Reference No. XM_005572266.2, "Predicted: Macaca fascicularis ataxin 2 (Atxn2), transcript variant X16, mRNA," Jan. 25, 2016, 3 pages.
NCBI Reference No. XM_008760500.2, "Predicted: Rattus norvegicus ataxin 2 (Atxn2), transcript variant X16, mRNA," Jul. 26, 2016, 3 pages.
NCBI Reference No. XM_021072908.1, "Predicted: Sus scrofa ataxin 2 (Atxn2), transcript variant X3, mRNA," May 13, 2017, 3 pages.
Pulst, "Antisense Oligonucleotides for treating Spinocerebellar Ataxia," NIH Grant 2018 Type 2, 2018, 3 pages.
Sances et al., "Modeling ALS with motor neurons derived from human induced pluripotent stem cells," Nat Neurosci., Apr. 2016, 19(4):542-553.
Santa Lucia, "A unified view of polymer, dumbbell, and oligonucleotide DNA nearest-neighbor thermodynamics," Proc Nathl Acad Sci USA, Feb. 17, 1998, 95(4)4460-1465.
Scholefield and Wood, "Therapeutic gene silencing strategies for polyglutamine disorders," Trends in Genetics, Jan. 2010, 26(1):29-38.
Scoles et al., "Antisense oligonucleotide therapy for spinocerebellar ataxia type 2," Nature, Apr. 20, 2017, 544:362-366.
Scoles et al., "Antisense oligonucleotides for the treatment of spinocerebellar ataxia type 2 (SCA2) (S32.002)," Neurology, Apr. 22, 2015, 84(14 Supplement):6 pages.
Scoles et al., "Treatment of Spinocerebellar Ataxia Type 2 (SCA2) with MOE Antisense Oligonucleotides (S47.006)," Neurology, May 1, 2014, 82(10 Supplement):6 pages.
Scoles et al., "Oligonucleotide therapeutics in neurodegenerative diseases," RNA Biology, 2018, 155(6):707-714.

(56) References Cited

OTHER PUBLICATIONS

Scoles et al., "Supplementary Tables," Apr. 1, 2017, [retrieved on Jul. 23, 2019], retrieved from URL <https://media.nature.com/original/nature-assets/nature/journal/v544/n7650/extref/nature22044-s2.xl sx>, 3 pages.

Scoles, "Antisense oligonucleotides for the treatment of spinocerebellar ataxia type 2" NIH Grant 2013, 2013, 3 pages.

Scoles, "Antisense oligonucleotides for the treatment of spinocerebellar ataxia type 2" NIH Grant 2014, 2014, 4 pages.

Scoles et al., "Antisense oligonucleotide therapy for spinocerebellar ataxia type 2," Nature, Apr. 1, 2017, Supplementary Information and Tables, 5 pages.

Seth et al., "Synthesis and biophysical evaluation of 2',4'-constrained 2'O-methoxyethyl and 2',4'-constrained 2'O-ethyl nucleic acid analogues," J Org Chem., Mar. 5, 2010, 75(5):1569-1581.

Sugimoto et al., "Thermodynamic Parameters To Predict Stability of RNA/DNA Hybrid Duplexes," Biochemistiy, 1995, 34(35):11211-11216.

Uhlmann, "Recent Advances in the Medical Chemistry of Antisense Oligonucleotides," Curr Opinion in Drug Development, 2000, 3(2):203-213 (Abstract Only).

Vendesompele et al., "Accurate normalization of real-time quantitative RT-PCR data by geometric averaging of multiple internal control genes," Genome Biology, Jun. 2002, 3(7):532-542.

Wan and Seth, "The Medicinal Chemistry of Therapeutic Oligonucleotides," J Med Chem., Jul. 19, 2016, 59(21):9645-9667.

Wang et al., "Differentiation of human induced pluripotent stem cells to mature functional Purkinje neurons," Scientific Reports, Mar. 18, 2015, 5(9232):1-9.

Xia et al., "RNAi suppresses polyglutamine-induced neurodegeneration in a model of spinocerebellar ataxia," Nature Medicine, 2004, 10(8):816-820.

OLIGONUCLEOTIDES FOR MODULATING ATXN2 EXPRESSION

FIELD OF INVENTION

The present invention relates to oligonucleotides (oligomers) that are complementary to and target ataxin 2 encoding nucleic acids (ATXN2), leading to reduction of the expression of ATXN2. Reduction of ATXN2 expression is beneficial for a range of medical disorders, such as neurodegenerative diseases including spinocerebellar ataxia type 2 (SCA2), amyotrophic lateral sclerosis (ALS), Alzheimer's frontotemporal dementia (FTD), parkinsonism and conditions with TDP-43 proteinopathies.

BACKGROUND

Expanded glutamine repeats of the ataxin 2 (ATXN2) protein, resulting from 31 or more CAG repeats in the ATXN2 gene cause spinocerebellar ataxia type 2 (SCA2), a rare neurodegenerative disorder. Furthermore, the expanded CAG repeats are a genetic risk factor for amyotrophic lateral sclerosis (ALS) via an RNA-dependent interaction with TAR DNA-binding protein 43 (TDP-43). Other neurodegenerative diseases related to TDP-43 proteinopathies are for example Alzheimer's frontotemporal dementia (FTD) and parkinsonism. Recently, TDP-43 transgene mice (TDP-43$^{T/Tg}$), which is an ALS relevant mouse model, were cross bread with Atxn2 negative mice, which resulted in significant increase of lifespan and improve motor function of the TDP-43$^{T/Tg}$Atxn2$^{-/-}$ mice (Becker et al 2017 Nature 544: 367-371). In the same article it was shown that TDP-43$^{T/Tg}$ mice treated with antisense oligonucleotides targeting ATXN2 had prolonged survival and improved motor performance.

Antisense oligonucleotides targeting ATXN2 has also been described in US 2017/175113, WO 2015/143246 and WO 2017/117496, where WO 2017/117496 in particular is directed to the treatment of ALS. Scoles et al 2017 Nature 544:362 evaluates the ability of an antisense oligonucleotide to reduce ATXN2 in cerebellum and showed localization to purkinje cells indicating a potential therapy for SCA2.

OBJECTIVE OF THE INVENTION

The present invention provides antisense oligonucleotides which modulate ATXN2 both in vivo and in vitro. The invention identified a specific target sequence present in intron 9 of the human ATXN2 pre-mRNA which may be targeted by antisense oligonucleotides to give effective ATXN2 inhibition. In particular targeting position 83118-83146 of SEQ ID NO: 1 is advantageous in terms of reducing ATXN2.

The invention also provides effective antisense oligonucleotide sequences and compounds which are capable of inhibiting ATXN2, and their use in treatment of diseases or disorders such as neurodegenerative diseases including spinocerebellar ataxia type 2 (SCA2), amyotrophic lateral sclerosis (ALS), Alzheimer's frontotemporal dementia (FTD), parkinsonism and conditions with TDP-43 proteinopathies.

SUMMARY OF INVENTION

The invention relates to antisense oligonucleotides which target the *Homo sapiens* Ataxin 2 (ATXN2) transcript and are capable of inhibiting the expression of ATXN2.

The invention provides for an antisense oligonucleotide of formula

```
                                        (SEQ ID NO 15_4)
            TCAcAttttactttaacCTC
``` wherein capital letters are beta-D-oxy LNA nucleosides, lowercase letters are DNA nucleosides, all LNA C are 5-methyl cytosine, all internucleoside linkages are phosphorothioate internucleoside linkages.

The invention provides for an oligonucleotide of formula

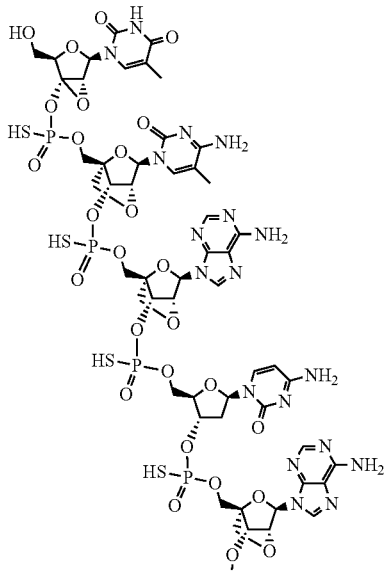

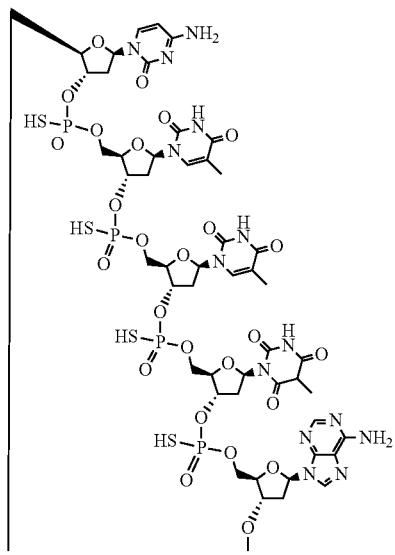

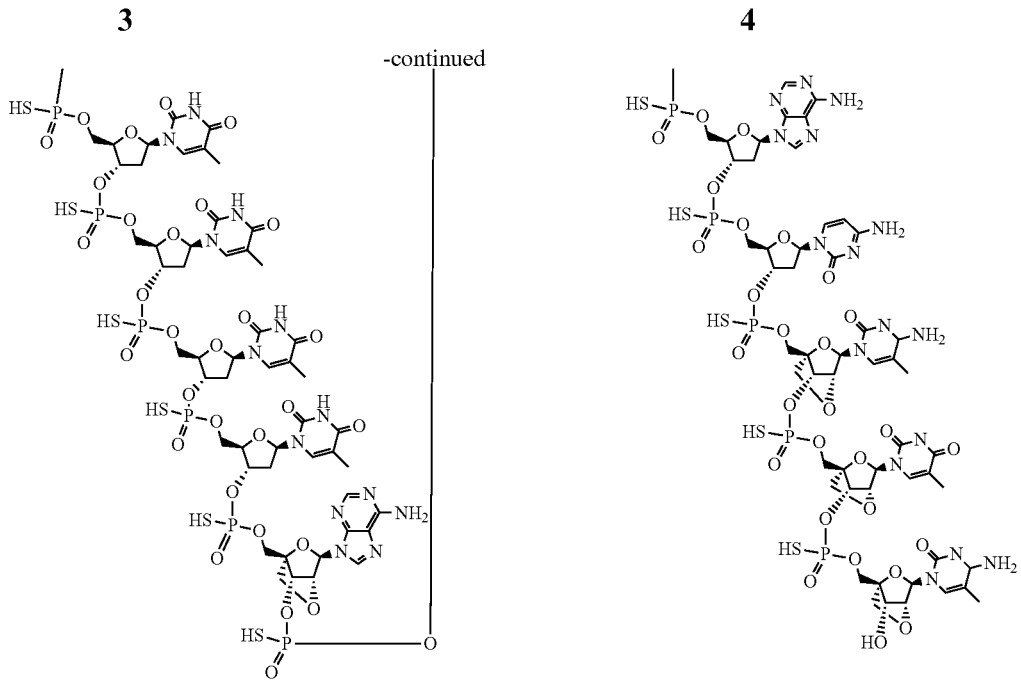

or a pharmaceutically acceptable salt thereof.

In some embodiments, the antisense oligonucleotide is in the form of a pharmaceutically acceptable salt.

In some embodiments, the antisense oligonucleotide is in the form of a pharmaceutically acceptable sodium salt.

In some embodiments, the antisense oligonucleotide is in the form of a pharmaceutically acceptable potassium salt.

The invention provides for a conjugate comprising the antisense oligonucleotide according to the invention, and at least one conjugate moiety covalently attached to said oligonucleotide. Alternatively stated, in some embodiments, the antisense oligonucleotide of the invention is in the form of a conjugated oligonucleotide. In some embodiments, the oligonucleotide is not conjugated.

The invention provides for a pharmaceutical composition comprising the antisense oligonucleotide or the conjugate of the invention, and a pharmaceutically acceptable diluent, solvent, carrier, salt and/or adjuvant.

In some embodiments, the composition comprises a pharmaceutically acceptable diluent, such as sterile phosphate buffered saline.

In some embodiments, the antisense oligonucleotide is formulated in a pharmaceutically acceptable diluent at a concentration of 50-300 µM solution. The diluent may be phosphate buffered saline.

In some embodiments, the antisense oligonucleotide is formulated in a pharmaceutically acceptable diluent at a concentration of 1-100 mg/mL, such as 2-30 or 2-50 mg/mL, or such as 4-30 mg/ml. The diluent may be phosphate buffered saline.

The invention provides for a method for modulating ATXN2 expression in a target cell which is expressing ATXN2, said method comprising administering an antisense oligonucleotide or the conjugate or the pharmaceutical composition, of the invention, in an effective amount to said cell. In some embodiments the method is an in vitro method. In some embodiments the method is an in vivo method. In some embodiments the cell is a neuronal cell, such as a cerebellum cell, such as a Purkinje cell, or a cortex cell.

The invention provides for the oligonucleotide, the conjugate, or the pharmaceutical composition the invention, for use in medicine.

The invention provides for the oligonucleotide, the conjugate, or the pharmaceutical composition, of the invention for use in the treatment of a disease selected from the group consisting of neurodegenerative disease selected from the group consisting of spinocerebellar ataxia type 2 (SCA2), amyotrophic lateral sclerosis (ALS), Alzheimer's, frontotemporal dementia (FTD), parkinsonism and conditions with TDP-43 proteinopathies.

The invention provides for the use of the oligonucleotide, the conjugate, or the pharmaceutical composition, of the invention, for the preparation of a medicament for treatment or prevention of a neurodegenerative disease, such as a disease selected from the group consisting of spinocerebellar ataxia type 2 (SCA2), amyotrophic lateral sclerosis (ALS), Alzheimer's, frontotemporal dementia (FTD), parkinsonism and conditions with TDP-43.

The invention provides for a method for treating or preventing a disease comprising administering a therapeutically or prophylactically effective amount of an antisense oligonucleotide, the conjugate or the pharmaceutical composition of the invention to a subject suffering from or susceptible to the disease, wherein the disease is selected from the group consisting of neurodegenerative disease selected from the group consisting of spinocerebellar ataxia type 2 (SCA2), amyotrophic lateral sclerosis (ALS), Alzheimer's, frontotemporal dementia (FTD), parkinsonism and conditions with TDP-43 proteinopathies.

In some embodiments, the disease is spinocerebellar ataxia type 2 (SCA2).

In some embodiments, disease is amyotrophic lateral sclerosis (ALS).

In a further aspect, the invention provides pharmaceutical compositions comprising the oligonucleotides of the invention and pharmaceutically acceptable diluents, carriers, salts and/or adjuvants.

In a further aspect, the invention provides methods for in vivo or in vitro method for modulation of ATXN expression in a target cell which is expressing ATXN2, by administering an oligonucleotide or composition of the invention in an effective amount to said cell.

In a further aspect the invention provides methods for treating or preventing a disease, disorder or dysfunction associated with in vivo activity of ATXN2 comprising administering a therapeutically or prophylactically effective amount of the oligonucleotide of the invention to a subject suffering from or susceptible to the disease, disorder or dysfunction.

In a further aspect the oligonucleotide or composition of the invention is used for the treatment or prevention of a neurodegenerative disease, such as a neurodegenerative disease selected from the group consisting of spinocerebellar ataxia type 2 (SCA2), amyotrophic lateral sclerosis (ALS), Alzheimer's frontotemporal dementia (FTD), parkinsonism and conditions with TDP-43 proteinopathies.

In a further aspect the oligonucleotide or composition of the invention is used for the treatment or prevention of spinocerebellar ataxia type 2 (SCA2) or amyotrophic lateral sclerosis (ALS).

FIGURES

FIG. 1 Compound 15_4 (sequence of nucleobases is shown in SEQ ID NO 15) The compound illustrated in FIG. 1 is shown in the protonated form—the S atom on the phosphorothioate linkage is protonated—it will be understood that the presence of the proton will depend on the acidity of the environment of the molecule, and the presence of an alternative cation (e.g. when the oligonucleotide is in salt form). Protonated phosphorothioates exist in tautomeric forms.

Figure 2:
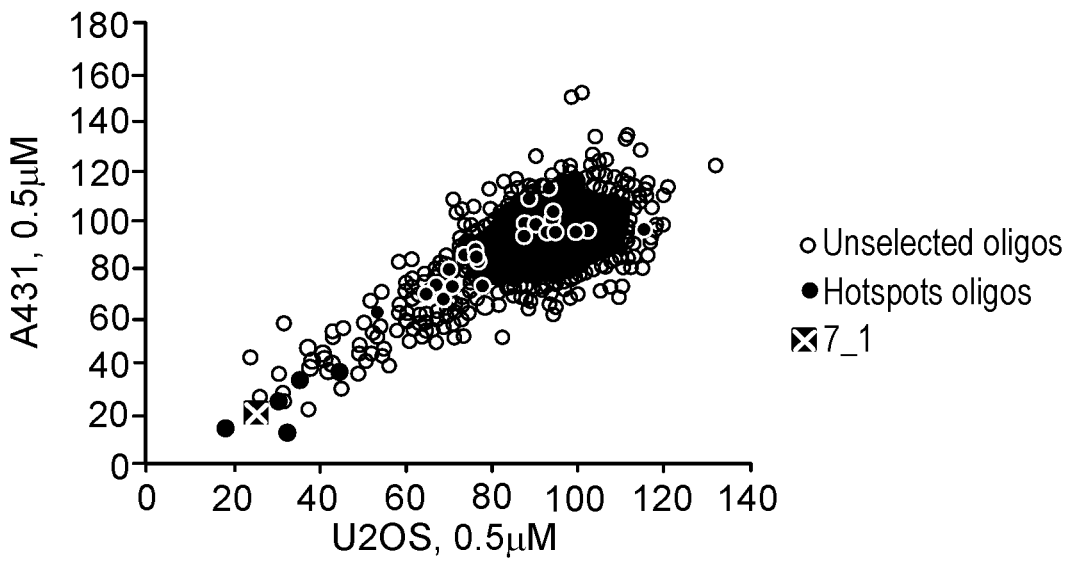

FIG. 2 Screening of 1500+ compounds targeting across the human Ataxin 2 pre-mRNA sequence in human cell lines. Compound 7_1 indicated as a hollow diamond.

Figure 3:
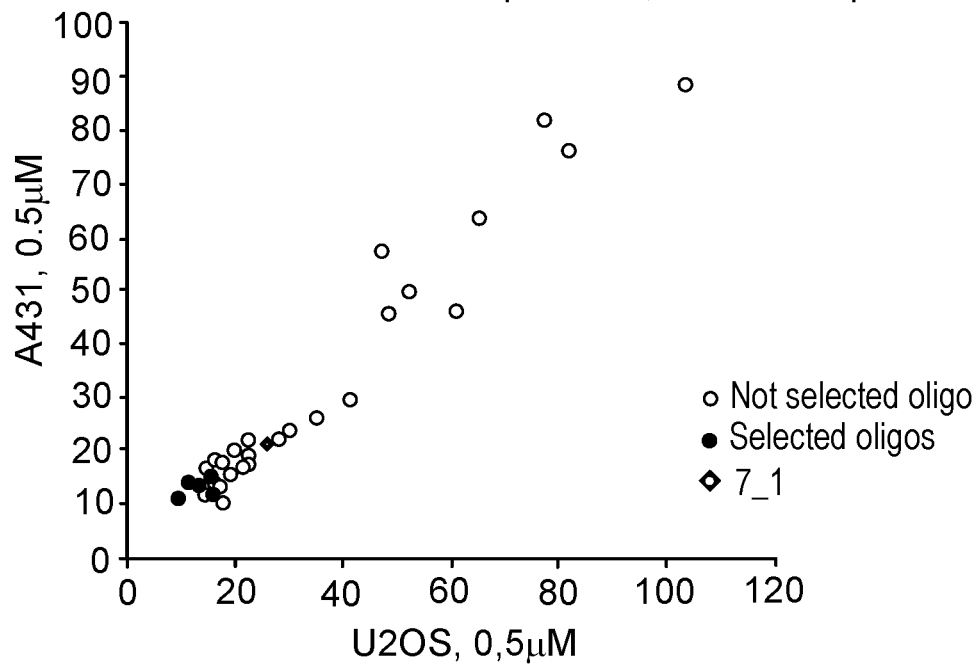
Figure 6:
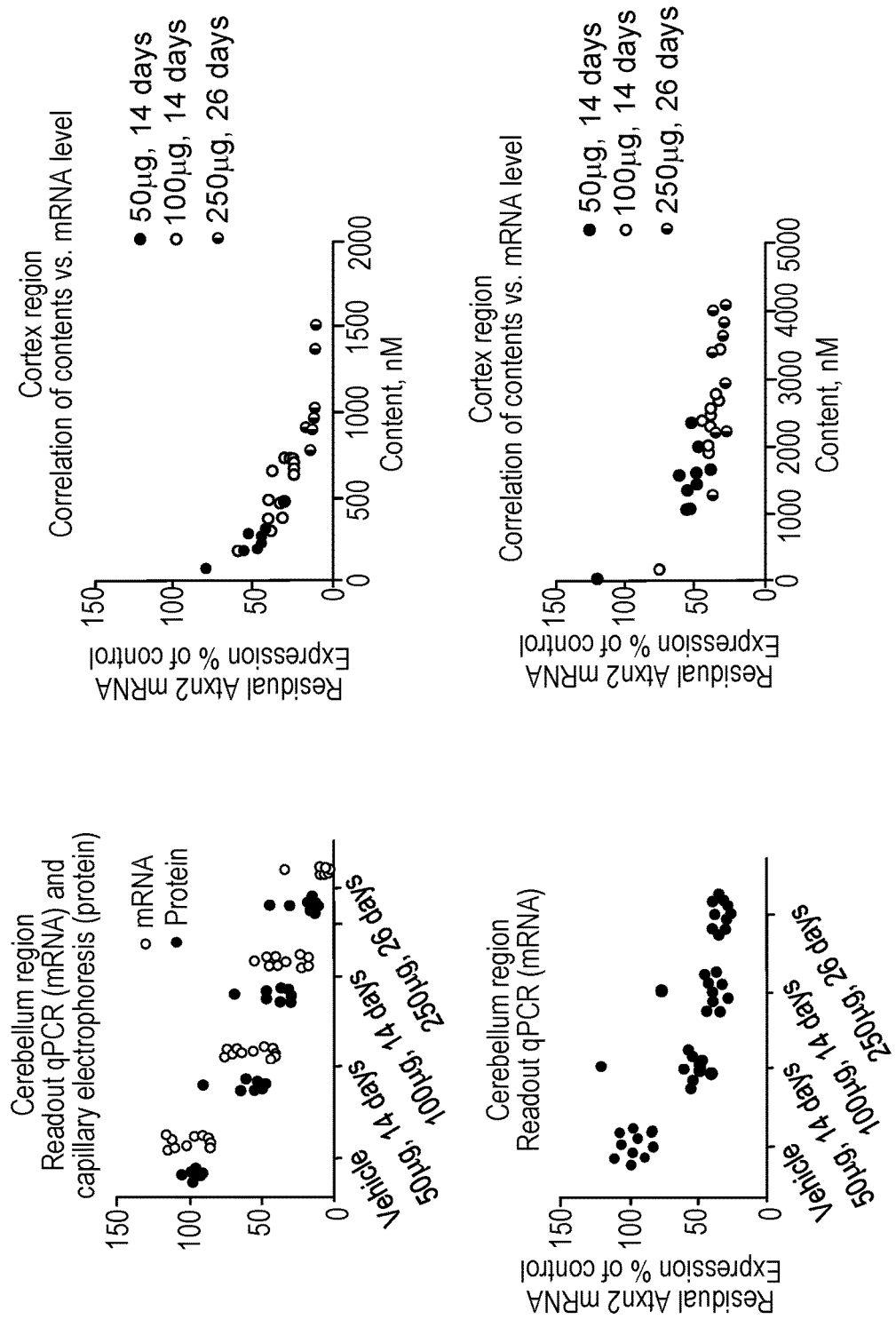

FIG. 3 As per FIG. 6, hotspot region SEQ ID NO 6 targeting compounds only. Compound 7_1 indicated as a hollow diamond.

Figure 4:
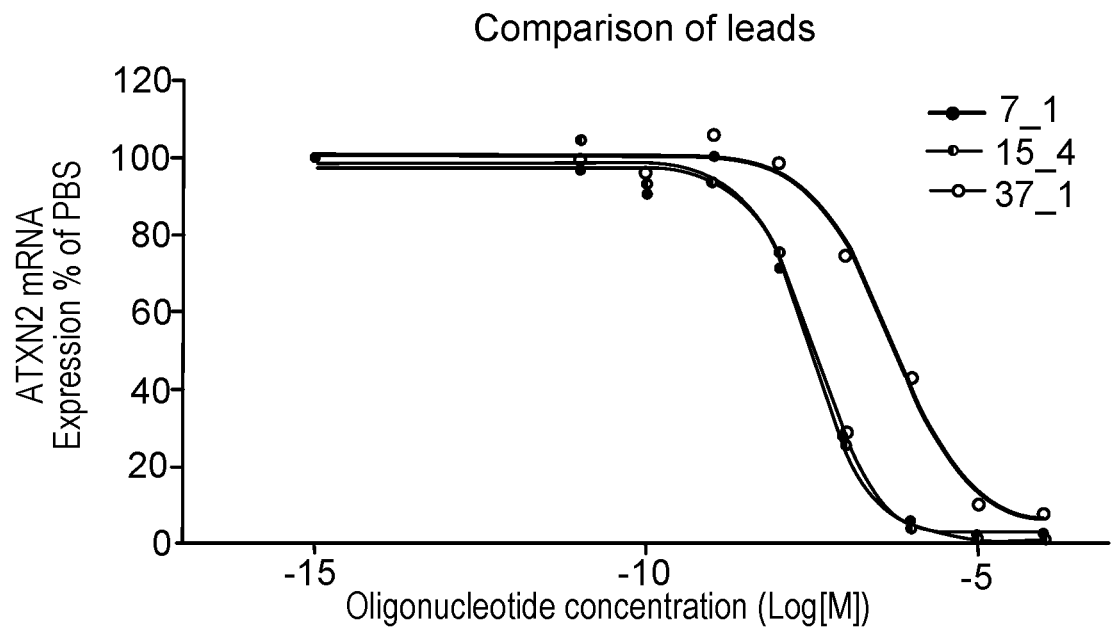

FIG. 4 In vitro potency assessment of compound 7_1 and 15_4, as compared to compound 37_1 (ASO7).

Figure 5:
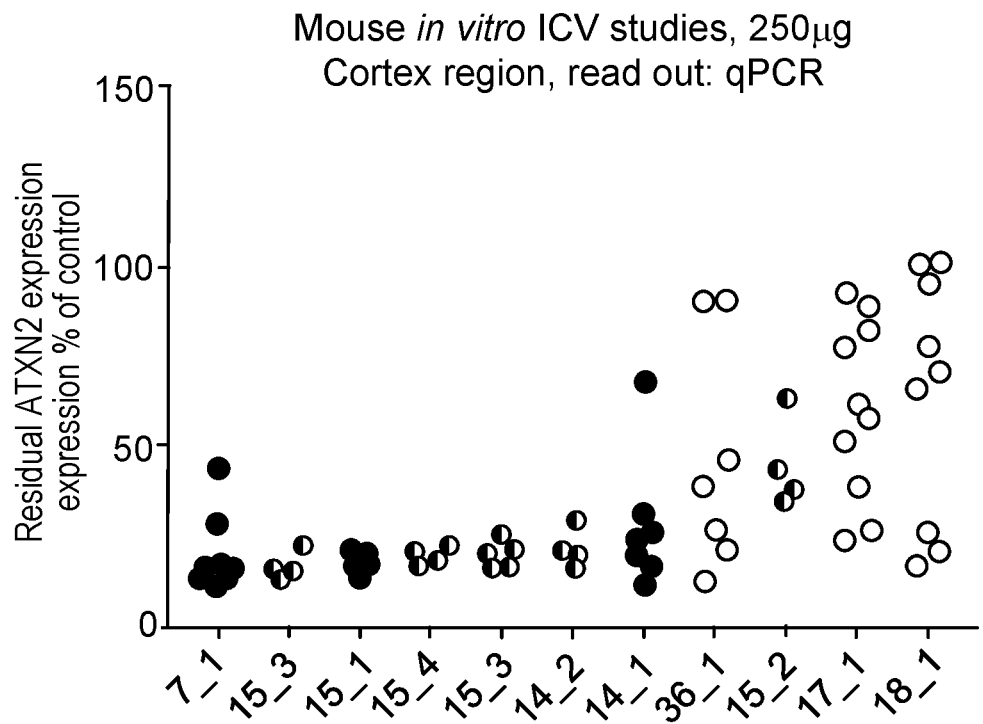

FIG. 5 In vivo mouse study—Comparison of the knock-down (mRNA) of 11 selected compounds, compiled data from the three experiments, study 1=filled dots, study 2=empty dots, study 3 half-filled dots.

FIG. 6 In vivo mouse study—Knock-down at protein and mRNA level and exposure in cortex, cerebellum regions for compound 7_1. Protein data for cortex only is shown.

Figure 7:
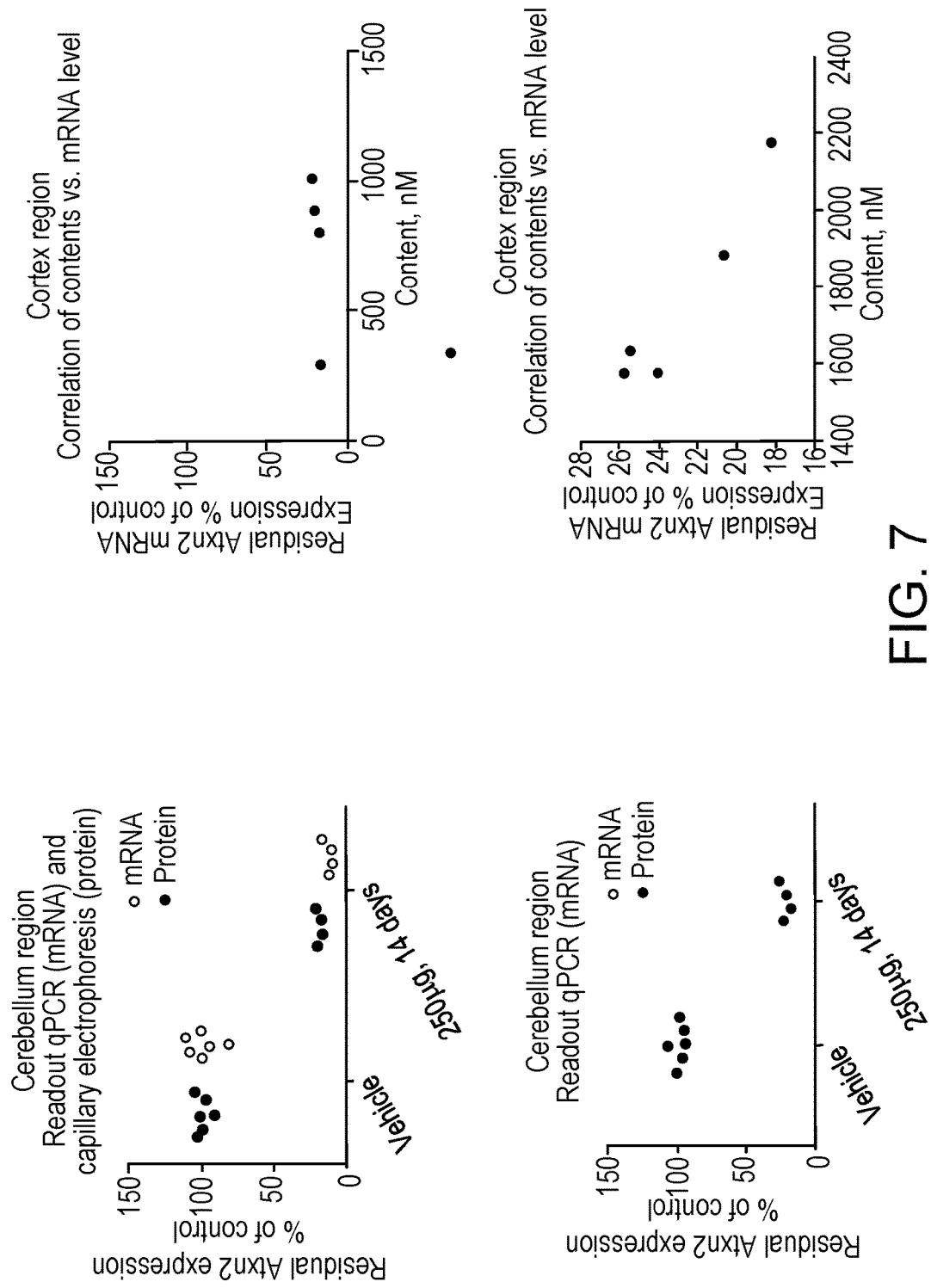

FIG. 7 In vivo mouse study—Knock-down at protein and mRNA level and exposure in cortex, cerebellum regions for compound 15_4. Protein data for cortex only is shown.

Figure 8:
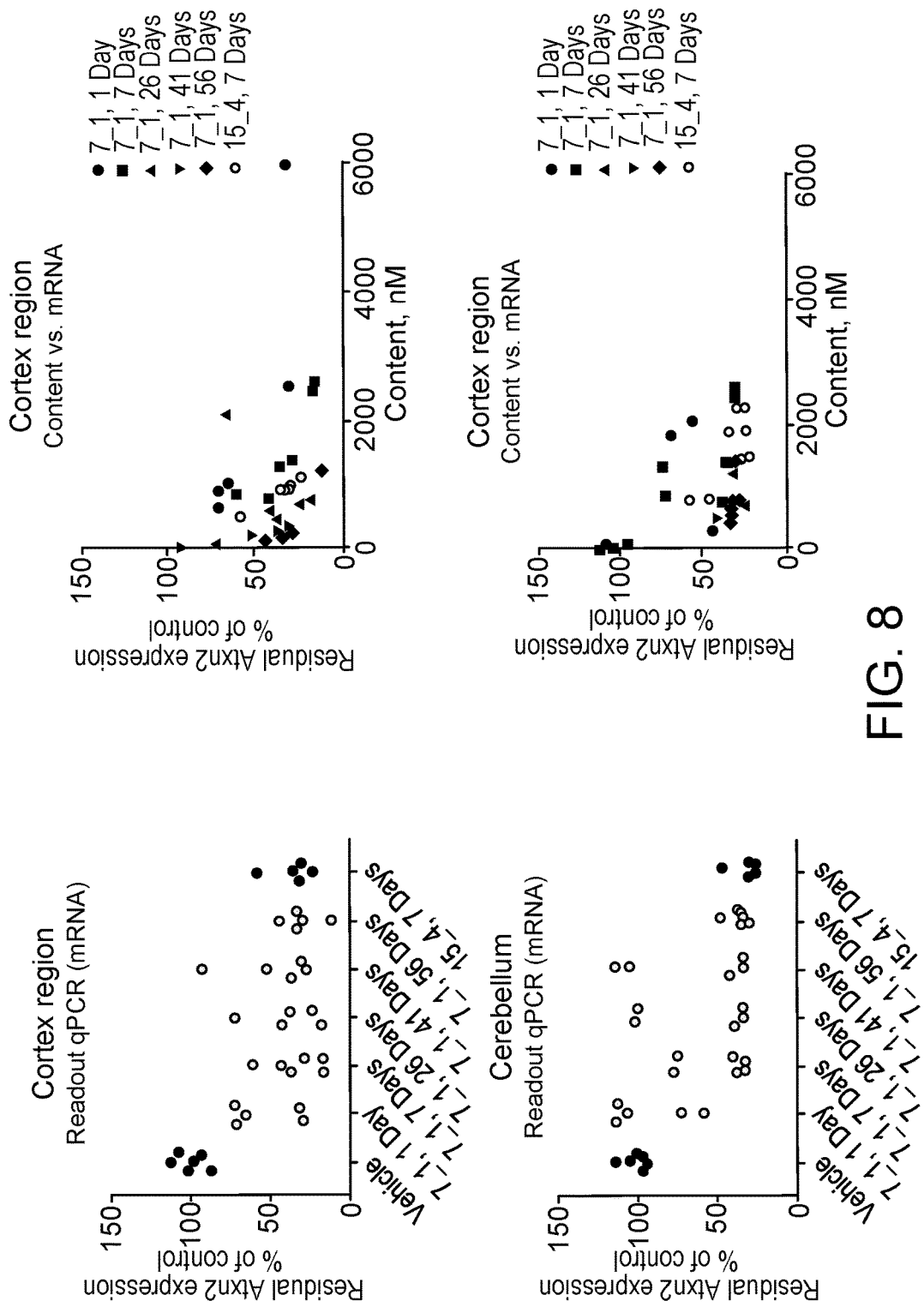

FIG. 8 Mouse in vivo study, time course after ICV administration of 150 µg of compound 7_1 & compound 15_4 (measured at 7 days only).

Figure 9:
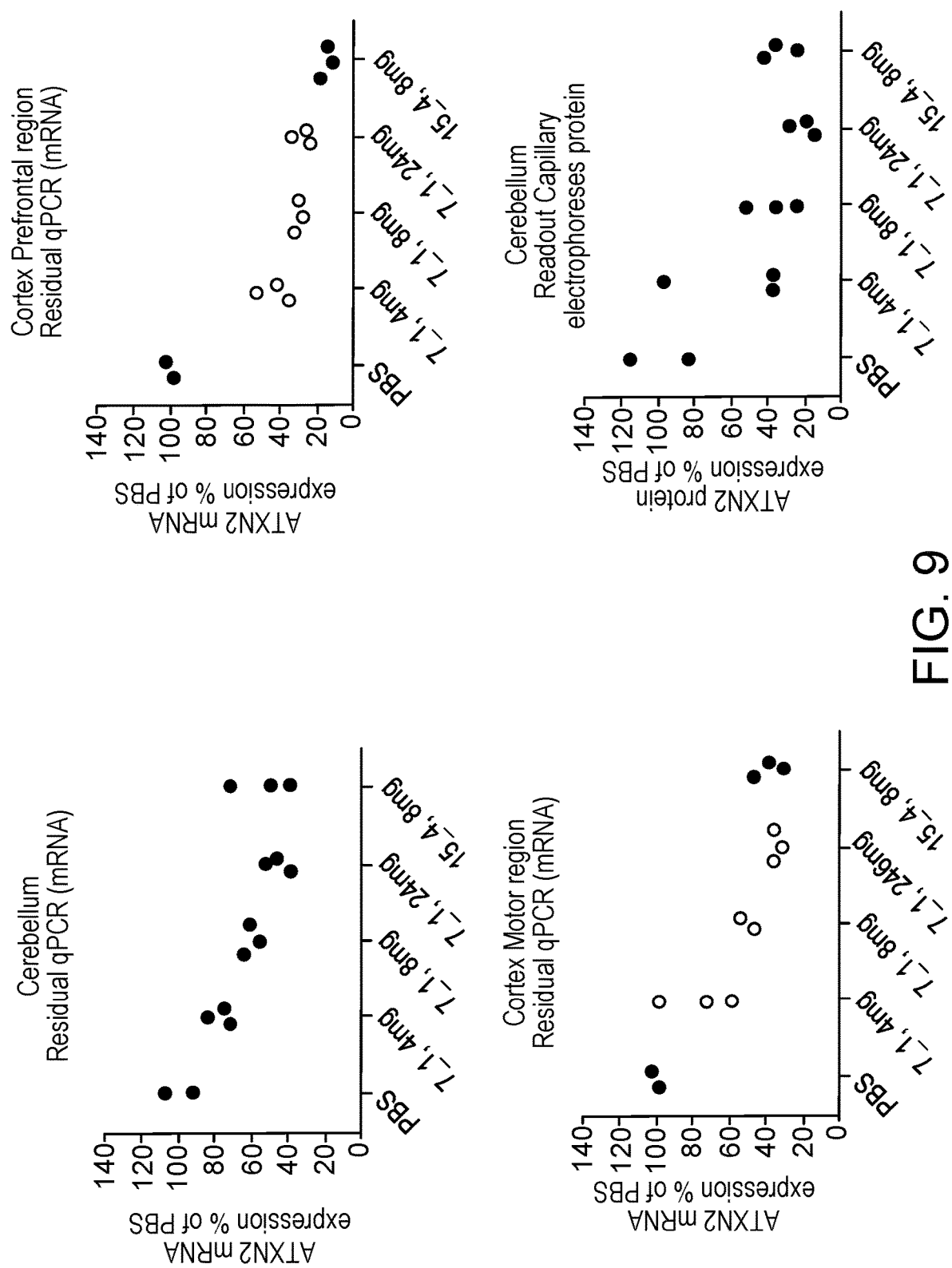

FIG. 9 NHP in vivo PK/PD study—mRNA and protein expression levels in key tissues after administration of 4, 8 or 24 mgs (compound 7_1) and 8 mgs of compound 15_4, measured 14 days after treatment.

Figure 10:
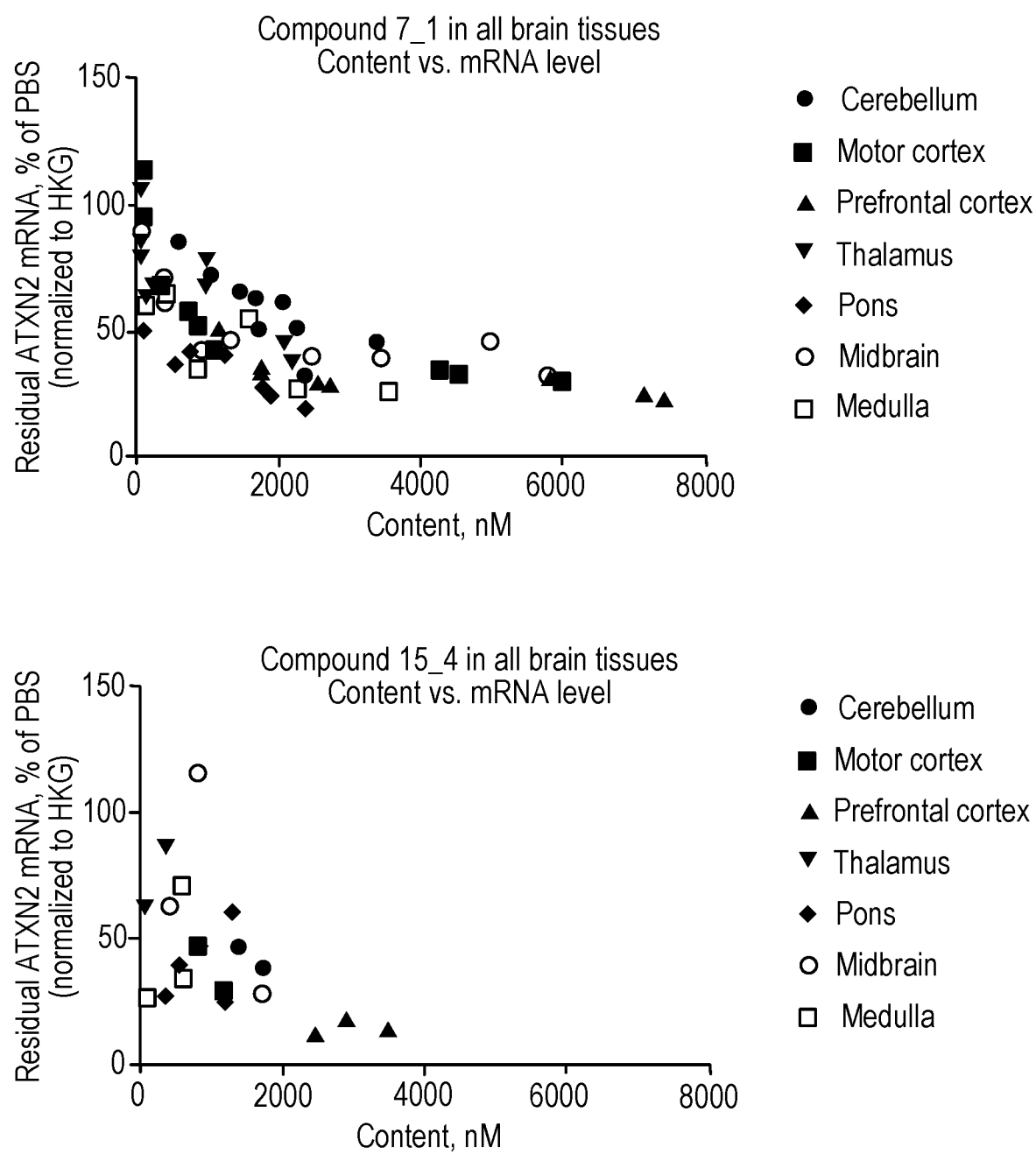

FIG. 10 NHP in vivo PK/PD study—mRNA and protein expression levels in key tissues after administration of 4, 8 or 24 mgs (compound 7_1) and 8 mgs of compound 15_4, measured 14 days after treatment. The data is presented to illustrate the relative specific activity of the two compounds.

DEFINITIONS

Oligonucleotide

The term "oligonucleotide" as used herein is defined as it is generally understood by the skilled person as a molecule comprising two or more covalently linked nucleosides. Such covalently bound nucleosides may also be referred to as nucleic acid molecules or oligomers.

Oligonucleotides are commonly made in the laboratory by solid-phase chemical synthesis followed by purification and isolation. When referring to a sequence of the oligonucleotide, reference is made to the sequence or order of nucleobase moieties, or modifications thereof, of the covalently linked nucleotides or nucleosides. The oligonucleotide of the invention is man-made, and is chemically synthesized, and is typically purified or isolated. The oligonucleotide of the invention may comprise one or more modified nucleosides or nucleotides, such as 2' sugar modified nucleosides.

Antisense Oligonucleotides

The term "Antisense oligonucleotide" as used herein is defined as oligonucleotides capable of modulating expression of a target gene by hybridizing to a target nucleic acid, in particular to a contiguous sequence on a target nucleic acid. The antisense oligonucleotides are not essentially double stranded and are therefore not siRNAs or shRNAs.

Contiguous Nucleotide Sequence

The term "contiguous nucleotide sequence" refers to the region of the oligonucleotide which is complementary to the target nucleic acid. The term is used interchangeably herein with the term "contiguous nucleobase sequence" and the term "oligonucleotide motif sequence". In some embodiments all the nucleotides of the oligonucleotide constitute the contiguous nucleotide sequence. In some embodiments the oligonucleotide comprises the contiguous nucleotide sequence, such as a F-G-F' gapmer region, and may optionally comprise further nucleotide(s), for example a nucleotide linker region which may be used to attach a functional group to the contiguous nucleotide sequence. The nucleotide linker region may or may not be complementary to the target nucleic acid.

Nucleotides

Nucleotides are the building blocks of oligonucleotides and polynucleotides, and for the purposes of the present invention include both naturally occurring and non-naturally occurring nucleotides. In nature, nucleotides, such as DNA and RNA nucleotides comprise a ribose sugar moiety, a nucleobase moiety and one or more phosphate groups (which is absent in nucleosides). Nucleosides and nucleotides may also interchangeably be referred to as "units" or "monomers".

Modified Nucleoside

The term "modified nucleoside" or "nucleoside modification" as used herein refers to nucleosides modified as compared to the equivalent DNA or RNA nucleoside by the introduction of one or more modifications of the sugar moiety or the (nucleo)base moiety. In a preferred embodiment the modified nucleoside comprise a modified sugar moiety. The term modified nucleoside may also be used herein interchangeably with the term "nucleoside analogue" or modified "units" or modified "monomers". Nucleosides with an unmodified DNA or RNA sugar moiety are termed DNA or RNA nucleosides herein. Nucleosides with modifications in the base region of the DNA or RNA nucleoside are still generally termed DNA or RNA if they allow Watson Crick base pairing.

Advantageously, all the internucleoside linkages of the contiguous nucleotide sequence of the oligonucleotide are phosphorothioate, or all the internucleoside linkages of the oligonucleotide are phosphorothioate linkages.

Phosphorothioate linkages may exist in different tautomeric forms, for example as illustrated below:

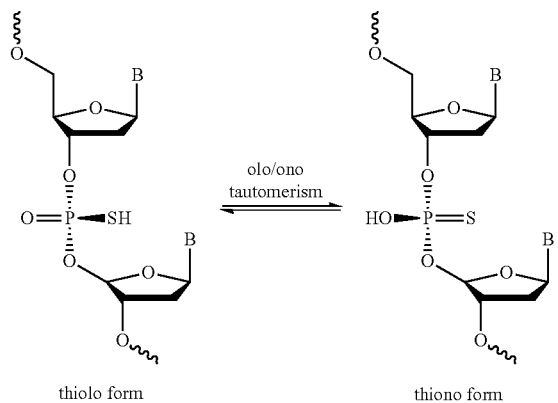

Nucleobase

The term nucleobase includes the purine (e.g. adenine and guanine) and pyrimidine (e.g. uracil, thymine and cytosine) moiety present in nucleosides and nucleotides which form hydrogen bonds in nucleic acid hybridization. In the context of the present invention the term nucleobase also encompasses modified nucleobases which may differ from naturally occurring nucleobases, but are functional during nucleic acid hybridization. In this context "nucleobase" refers to both naturally occurring nucleobases such as adenine, guanine, cytosine, thymidine, uracil, xanthine and hypoxanthine, as well as non-naturally occurring variants. Such variants are for example described in Hirao et al (2012) Accounts of Chemical Research vol 45 page 2055 and Bergstrom (2009) Current Protocols in Nucleic Acid Chemistry Suppl. 37 1.4.1.

In some embodiments the nucleobase moiety is modified by changing the purine or pyrimidine into a modified purine or pyrimidine, such as substituted purine or substituted pyrimidine, such as a nucleobased selected from isocytosine, pseudoisocytosine, 5-methyl cytosine, 5-thiozolo-cytosine, 5-propynyl-cytosine, 5-propynyl-uracil, 5-bromouracil 5-thiazolo-uracil, 2-thio-uracil, 2'thio-thymine, inosine, diaminopurine, 6-aminopurine, 2-aminopurine, 2,6-di-aminopurine and 2-chloro-6-aminopurine.

The nucleobase moieties may be indicated by the letter code for each corresponding nucleobase, e.g. A, T, G, C or U, wherein each letter may optionally include modified nucleobases of equivalent function. For example, in the exemplified oligonucleotides, the nucleobase moieties are selected from A, T, G, C, and 5-methyl cytosine. Optionally, for LNA gapmers, 5-methyl cytosine LNA nucleosides may be used.

Modified Oligonucleotide

The term modified oligonucleotide describes an oligonucleotide comprising one or more sugar-modified nucleosides and/or modified internucleoside linkages. The term chimeric" oligonucleotide is a term that has been used in the literature to describe oligonucleotides with modified nucleosides.

Complementarity

The term "complementarity" describes the capacity for Watson-Crick base-pairing of nucleosides/nucleotides. Watson-Crick base pairs are guanine (G)-cytosine (C) and adenine (A)-thymine (T)/uracil (U). It will be understood that oligonucleotides may comprise nucleosides with modified nucleobases, for example 5-methyl cytosine is often used in place of cytosine, and as such the term complementarity encompasses Watson Crick base-paring between non-modified and modified nucleobases (see for example Hirao et al (2012) Accounts of Chemical Research vol 45 page 2055 and Bergstrom (2009) Current Protocols in Nucleic Acid Chemistry Suppl. 37 1.4.1).

The term "% complementary" as used herein, refers to the proportion of nucleotides (in percent) of a contiguous nucleotide sequence in a nucleic acid molecule (e.g. oligonucleotide) which across the contiguous nucleotide sequence, are complementary to a reference sequence (e.g. a target sequence or sequence motif). The percentage of complementarity is thus calculated by counting the number of aligned nucleobases that are complementary (from Watson Crick base pair) between the two sequences (when aligned with the target sequence 5'-3' and the oligonucleotide sequence from 3'-5'), dividing that number by the total number of nucleotides in the oligonucleotide and multiplying by 100. In such a comparison a nucleobase/nucleotide which does not align (form a base pair) is termed a mismatch. Insertions and deletions are not allowed in the calculation of % complementarity of a contiguous nucleotide sequence. It will be understood that in determining complementarity, chemical modifications of the nucleobases are disregarded as long as the functional capacity of the nucleobase to form Watson Crick base pairing is retained (e.g. 5'-methyl cytosine is considered identical to a cytosine for the purpose of calculating % identity).

The term "fully complementary", refers to 100% complementarity.

The following is an example of an oligonucleotide that is fully complementary to the target sequence.

The following is an example of an oligonucleotide (SEQ ID NO: 15) that is fully complementary to the target sequence (SEQ ID NO: 6).

```
                                        (SEQ ID NO: 6)
       5' ttaaggaggttaaagtaaaatgtgaattt 3'

(SEQ ID NO: 15)
       3'       ctccaatttcattttacact 5'
```

Identity

The term "Identity" as used herein, refers to the proportion of nucleotides (expressed in percent) of a contiguous nucleotide sequence in a nucleic acid molecule (e.g. oligonucleotide) which across the contiguous nucleotide sequence, are identical to a reference sequence (e.g. a sequence motif). The percentage of identity is thus calculated by counting the number of aligned nucleobases that are identical (a Match) between two sequences (in the contiguous nucleotide sequence of the compound of the invention and in the reference sequence), dividing that number by the total number of nucleotides in the oligonucleotide and multiplying by 100. Therefore, Percentage of Identity= (Matches×100)/Length of aligned region (e.g. the contiguous nucleotide sequence). Insertions and deletions are not allowed in the calculation the percentage of identity of a contiguous nucleotide sequence. It will be understood that in determining identity, chemical modifications of the nucleobases are disregarded as long as the functional capacity of the nucleobase to form Watson Crick base pairing is retained (e.g. 5-methyl cytosine is considered identical to a cytosine for the purpose of calculating % identity).

Hybridization

The term "hybridizing" or "hybridizes" as used herein is to be understood as two nucleic acid strands (e.g. an oligonucleotide and a target nucleic acid) forming hydrogen bonds between base pairs on opposite strands thereby forming a duplex. The affinity of the binding between two nucleic acid strands is the strength of the hybridization. It is often described in terms of the melting temperature ($T_m$) defined as the temperature at which half of the oligonucleotides are duplexed with the target nucleic acid. At physiological conditions $T_m$ is not strictly proportional to the affinity (Mergny and Lacroix, 2003, *Oligonucleotides* 13:515-537). The standard state Gibbs free energy $\Delta G°$ is a more accurate representation of binding affinity and is related to the dissociation constant ($K_d$) of the reaction by $\Delta G°=-RT\ln(K_d)$, where R is the gas constant and T is the absolute temperature. Therefore, a very low $\Delta G°$ of the reaction between an oligonucleotide and the target nucleic acid reflects a strong hybridization between the oligonucleotide and target nucleic acid. $\Delta G°$ is the energy associated with a reaction where aqueous concentrations are 1M, the pH is 7, and the temperature is 37° C. The hybridization of oligonucleotides to a target nucleic acid is a spontaneous reaction and for spontaneous reactions $\Delta G°$ is less than zero. $\Delta G°$ can be measured experimentally, for example, by use of the isothermal titration calorimetry (ITC) method as described in Hansen et al., 1965, *Chem. Comm*, 36-38 and Holdgate et al., 2005, *Drug Discov Today*. The skilled person will know that commercial equipment is available for $\Delta G°$ measurements. $\Delta G°$ can also be estimated numerically by using the nearest neighbor model as described by SantaLucia, 1998, *Proc Natl Acad Sci USA*. 95: 1460-1465 using appropriately derived thermodynamic parameters described by Sugimoto et al., 1995, *Biochemistry* 34:11211-11216 and McTigue et al., 2004, *Biochemistry* 43:5388-5405. In order to have the possibility of modulating its intended nucleic acid target by hybridization, oligonucleotides of the present invention hybridize to a target nucleic acid with estimated $\Delta G°$ values below -10 kcal for oligonucleotides that are 10-30 nucleotides in length. In some embodiments the degree or strength of hybridization is measured by the standard state Gibbs free energy $\Delta G°$. The oligonucleotides may hybridize to a target nucleic acid with estimated $\Delta G°$ values below the range of -10 kcal, such as below -15 kcal, such as below -20 kcal and such as below -25 kcal for oligonucleotides that are 8-30 nucleotides in length. In some embodiments the oligonucleotides hybridize to a target nucleic acid with an estimated $\Delta G°$ value of -10 to -60 kcal, such as -12 to -40, such as from -15 to -30 kcal or -16 to -27 kcal such as -18 to -25 kcal.

Target Nucleic Acid

According to the present invention, the target nucleic acid is a nucleic acid which encodes mammalian ATXN2 and may for example be a gene, a RNA, a mRNA, and pre-mRNA, a mature mRNA or a cDNA sequence. The target may therefore be referred to as an ATXN2 target nucleic acid.

TABLE 1 human ATXN2 Exons and Introns

| | Exonic regions in the human ATXN2 premRNA (SEQ ID NO 1) | | | Intronic regions in the human ATXN2 premRNA (SEQ ID NO 1) | |
|---|---|---|---|---|---|
| ID | start | end | ID | start | end |
| e1 | 1 | 893 | i1 | 894 | 43757 |
| e2 | 43758 | 43794 | i2 | 43795 | 45459 |
| e3 | 45460 | 45519 | i3 | 45520 | 46699 |
| e4 | 46700 | 46771 | i4 | 46772 | 47246 |
| e5 | 47247 | 47397 | i5 | 47398 | 74360 |
| e6 | 74361 | 74485 | i6 | 74486 | 78703 |
| e7 | 78704 | 78795 | i7 | 78796 | 79600 |
| e8 | 79601 | 79798 | i8 | 79799 | 81249 |
| e9 | 81250 | 81428 | i9 | 81429 | 83313 |
| e10 | 83314 | 83523 | i10 | 83524 | 86137 |
| e11 | 86138 | 86320 | i11 | 86321 | 89094 |
| e12 | 89095 | 89292 | i12 | 89293 | 89678 |
| e13 | 89679 | 89786 | i13 | 89787 | 90057 |
| e14 | 90058 | 90128 | i14 | 90129 | 110896 |
| e15 | 110897 | 111201 | i15 | 111202 | 112852 |
| e16 | 112853 | 112916 | i16 | 112917 | 113811 |
| e17 | 113812 | 113964 | i17 | 113965 | 114345 |
| e18 | 114346 | 114406 | i18 | 114407 | 128934 |
| e19 | 128935 | 129119 | i19 | 129120 | 129436 |
| e20 | 129437 | 129569 | i20 | 129570 | 134961 |
| e21 | 134962 | 135015 | i21 | 135016 | 142317 |
| e22 | 142318 | 142463 | i22 | 142464 | 143420 |
| e23 | 143421 | 143648 | i23 | 143649 | 145831 |
| e24 | 145832 | 146000 | i24 | 146001 | 146836 |
| e25 | 146837 | 147463 | | | |

Suitably, the target nucleic acid encodes an ATXN2 protein, in particular mammalian ATXN2, such as human ATXN2 (See for example tables 2 and 3) which provides the mRNA and pre-mRNA sequences for human, monkey, rat and pig ATXN2).

In some embodiments, the target nucleic acid is selected from the group consisting of SEQ ID NO: 1, 2, 3, 4 and 5 or naturally occurring variants thereof (e.g. sequences encoding a mammalian Ataxin 2 protein).

If employing the oligonucleotide of the invention in research or diagnostics the target nucleic acid may be a cDNA or a synthetic nucleic acid derived from DNA or RNA.

For in vivo or in vitro application, the oligonucleotide of the invention is typically capable of inhibiting the expression of the ATXN2 target nucleic acid in a cell which is expressing the ATXN2 target nucleic acid. The contiguous sequence of nucleobases of the oligonucleotide of the invention is typically complementary to the ATXN2 target nucleic acid, as measured across the length of the oligonucleotide, optionally with the exception of one or two mismatches, and optionally excluding nucleotide based linker regions which may link the oligonucleotide to an optional functional group such as a conjugate, or other non-complementary terminal nucleotides (e.g. region D' or D"). The target nucleic acid may, in some embodiments, be a RNA or DNA, such as a messenger RNA, such as a mature mRNA or a pre-mRNA.

In some embodiments the target nucleic acid is a RNA or DNA which encodes mammalian Ataxin2 protein, such as human ATXN2, e.g. the human ATXN2 mRNA sequence, such as that disclosed as SEQ ID NO 1. Further information on exemplary target nucleic acids is provided in tables 2 and 3.

TABLE 2

Genome and assembly information for ATXN2 across species.

| Species | Chr. | Strand | Genomic coordinates Start | End | Assembly | NCBI reference sequence* accession number for mRNA |
|---|---|---|---|---|---|---|
| Human | 12 | Rv | 111452214 | 111599676 | GRCh38 | NM_002973.3 |
| Cynomolgus monkey | 11 | Rv | 115099975 | 115257793 | Macaca_fascicularis_5.0 | XM_005572266.2 |
| Mouse | 5 | Fwd | 121711609 | 121814950 | GRCm38 | NM_009125.2 |
| Rat | 12 | Rv | 40264601 | 40335637 | Rnor_6.0 | XM_008760500.2 |
| Pig | 14 | Rv | 32656537 | 32772082 | Sscrofa11.1 | XM_021072908.1 |

Fwd = forward strand. The genome coordinates provide the pre-mRNA sequence (genomic sequence). The NCBI reference provides the mRNA sequence (cDNA sequence).
*The National Center for Biotechnology Information reference sequence database is a comprehensive, integrated, non-redundant, well-annotated set of reference sequences including genomic, transcript, and protein. It is hosted at www.ncbi.nlm.nih.gov/refseq.

TABLE 3

Sequence details for ATXN2 across species.

| Species | RNA type | Length (nt) | SEQ ID NO |
|---|---|---|---|
| Human | premRNA | 147463 | 1 |
| Cyno | premRNA | 155409 | 2 |
| Mouse | premRNA | 103342 | 3 |
| Rat | premRNA | 69817 | 4 |
| Pig | premRNA | 115546 | 5 |

Target Sequence

The term "target sequence" as used herein refers to a sequence of nucleotides present in the target nucleic acid which comprises the nucleobase sequence which is complementary to the oligonucleotide of the invention. In some embodiments, the target sequence consists of a region on the target nucleic acid with a nucleobase sequence that is complementary to the contiguous nucleotide sequence of the oligonucleotide of the invention. This region of the target nucleic acid may interchangeably be referred to as the target nucleotide sequence, target sequence or target region. In some embodiments the target sequence is longer than the complementary sequence of a single oligonucleotide, and may, for example represent a preferred region of the target nucleic acid which may be targeted by several oligonucleotides of the invention.

In some embodiments the target sequence is a sequence selected from human ATXN2 mRNA intron 9, (see table 1 above).

In one embodiment of the invention the target sequence is SEQ ID NO: 6.

The oligonucleotide of the invention comprises a contiguous nucleotide sequence which is complementary to or hybridizes to the target nucleic acid, such as a target sequence described herein.

The target sequence to which the oligonucleotide is complementary or hybridizes to generally comprises a contiguous nucleobases sequence of at least 10 nucleotides. The contiguous nucleotide sequence is between 10 to 50 nucleotides, such as 12 to 30, such as 14 to 20, such as 15 to 18 contiguous nucleotides.

Target Cell

The term a "target cell" as used herein refers to a cell which is expressing the target nucleic acid. In some embodiments the target cell may be in vivo or in vitro. In some embodiments the target cell is a mammalian cell such as a rodent cell, such as a mouse cell or a rat cell, or a primate cell such as a monkey cell or a human cell.

In some embodiments the target cell may be a purkinje neuron, such as purkinje cells. Other relevant target cells are motor neurons, such as upper motor neurons and lower motor neurons.

For in vitro assessment, the target cell may be an established cell line, such as A431 or U2-OS cells. Alternatively, motor neurons derived from human induced pluripotent stem cells (iPCSs) (see for example Sances et al 2016 Nat Neurosci. 19(4): 542-553) or iPCS derived prukinje cells (Wang et al 2015 Scientific Reports 5:9232) may be used for in vitro screening.

In preferred embodiments the target cell expresses ATXN2 mRNA, such as the ATXN2 pre-mRNA or ATXN2 mature mRNA. The poly A tail of ATXN2 mRNA is typically disregarded for antisense oligonucleotide targeting.

Naturally Occurring Variant

The term "naturally occurring variant" refers to variants of ATXN2 gene or transcripts which originate from the same genetic loci as the target nucleic acid, but may differ for example, by virtue of degeneracy of the genetic code causing a multiplicity of codons encoding the same amino acid, or due to alternative splicing of pre-mRNA, or the presence of polymorphisms, such as single nucleotide polymorphisms (SNPs), and allelic variants. Based on the presence of the sufficient complementary sequence to the oligonucleotide, the oligonucleotide of the invention may therefore target the target nucleic acid and naturally occurring variants thereof.

In some embodiments, the naturally occurring variants have at least 95% such as at least 98% or at least 99% homology to a mammalian ATXN2 target nucleic acid, such as a target nucleic acid selected form the group consisting of SEQ ID NO: 1, 2, 3, 4 and 5. In some embodiments the naturally occurring variants have at least 99% homology to the human ATXN2 target nucleic acid of SEQ ID NO: 1.

Modulation of Expression

The term "modulation of expression" as used herein is to be understood as an overall term for an oligonucleotide's ability to alter the amount of ATXN2 when compared to the amount of ATXN2 before administration of the oligonucleotide. Alternatively, modulation of expression may be determined by reference to a control experiment. It is generally understood that the control is an individual or target cell treated with a saline composition or an individual or target cell treated with a non-targeting oligonucleotide (mock).

One type of modulation is the ability of an oligonucleotide to inhibit, down-regulate, reduce, suppress, remove, stop, block, prevent, lessen, lower, avoid or terminate expression of ATXN2, e.g. by degradation of mRNA or blockage of transcription. The antisense oligonucleotides of the invention advantageously are capable of inhibiting the expression of a mammalian ATXN2, such as human ATXN2.

High Affinity Modified Nucleosides

A high affinity modified nucleoside is a modified nucleotide which, when incorporated into the oligonucleotide enhances the affinity of the oligonucleotide for its complementary target, for example as measured by the melting temperature ($T_m$). A high affinity modified nucleoside of the present invention preferably result in an increase in melting temperature between +0.5 to +12° C., more preferably between +1.5 to +10° C. and most preferably between +3 to +8° C. per modified nucleoside. Numerous high affinity modified nucleosides are known in the art and include for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3(2), 293-213).

Sugar Modifications

The oligomer of the invention may comprise one or more nucleosides which have a modified sugar moiety, i.e. a modification of the sugar moiety when compared to the ribose sugar moiety found in DNA and RNA.

Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradicle bridge between the C2 and C4 carbons on the ribose ring (LNA), or an unlinked ribose ring which typically lacks a bond between the C2 and C3 carbons (e.g. UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'-OH group naturally found in DNA and RNA nucleosides. Substituents may, for example be introduced at the 2', 3', 4' or 5' positions.

2' Sugar Modified Nucleosides

A 2' sugar modified nucleoside is a nucleoside which has a substituent other than H or —OH at the 2' position (2' substituted nucleoside) or comprises a 2' linked biradicle capable of forming a bridge between the 2' carbon and a second carbon in the ribose ring, such as LNA (2'-4' biradicle bridged) nucleosides.

Indeed, much focus has been spent on developing 2' sugar substituted nucleosides, and numerous 2' substituted nucleosides have been found to have beneficial properties when incorporated into oligonucleotides. For example, the 2' modified sugar may provide enhanced binding affinity and/or increased nuclease resistance to the oligonucleotide. Examples of 2' substituted modified nucleosides are 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, and 2'-F-ANA nucleoside. For further examples, please see e.g. Freier & Altmann; Nucl. Acid Res., 1997, 25, 4429-4443 and Uhlmann; Curr. Opinion in Drug Development, 2000, 3(2), 293-213, and Deleavey and Damha, Chemistry and Biology 2012, 19, 937. Below are illustrations of some 2' substituted modified nucleosides.

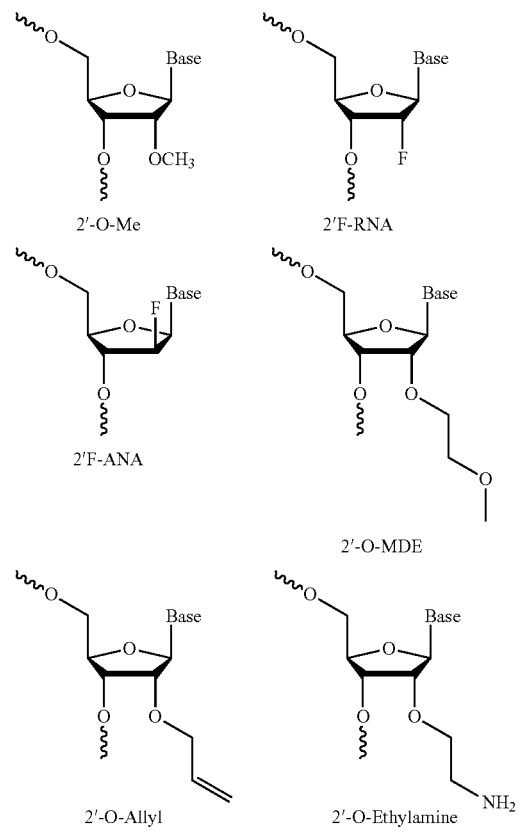

In relation to the present invention 2' substituted sugar modified nucleosides does not include 2' bridged nucleosides like LNA.

Locked Nucleic Acid Nucleosides (LNA Nucleoside)

A "LNA nucleoside" is a 2'-modified nucleoside which comprises a biradical linking the C2' and C4' of the ribose sugar ring of said nucleoside (also referred to as a "2'-4' bridge"), which restricts or locks the conformation of the ribose ring. These nucleosides are also termed bridged nucleic acid or bicyclic nucleic acid (BNA) in the literature. The locking of the conformation of the ribose is associated with an enhanced affinity of hybridization (duplex stabilization) when the LNA is incorporated into an oligonucleotide for a complementary RNA or DNA molecule. This can be routinely determined by measuring the melting temperature of the oligonucleotide/complement duplex.

Non limiting, exemplary LNA nucleosides are disclosed in WO 99/014226, WO 00/66604, WO 98/039352, WO 2004/046160, WO 00/047599, WO 2007/134181, WO 2010/077578, WO 2010/036698, WO 2007/090071, WO 2009/006478, WO 2011/156202, WO 2008/154401, WO 2009/067647, WO 2008/150729, Morita et al., Bioorganic & Med. Chem. Lett. 12, 73-76, Seth et al. J. Org. Chem. 2010, Vol 75(5) pp. 1569-81, and Mitsuoka et al., Nucleic Acids Research 2009, 37(4), 1225-1238, and Wan and Seth, J. Medical Chemistry 2016, 59, 9645-9667.

Further non limiting, exemplary LNA nucleosides are disclosed in Scheme 1.

Scheme 1

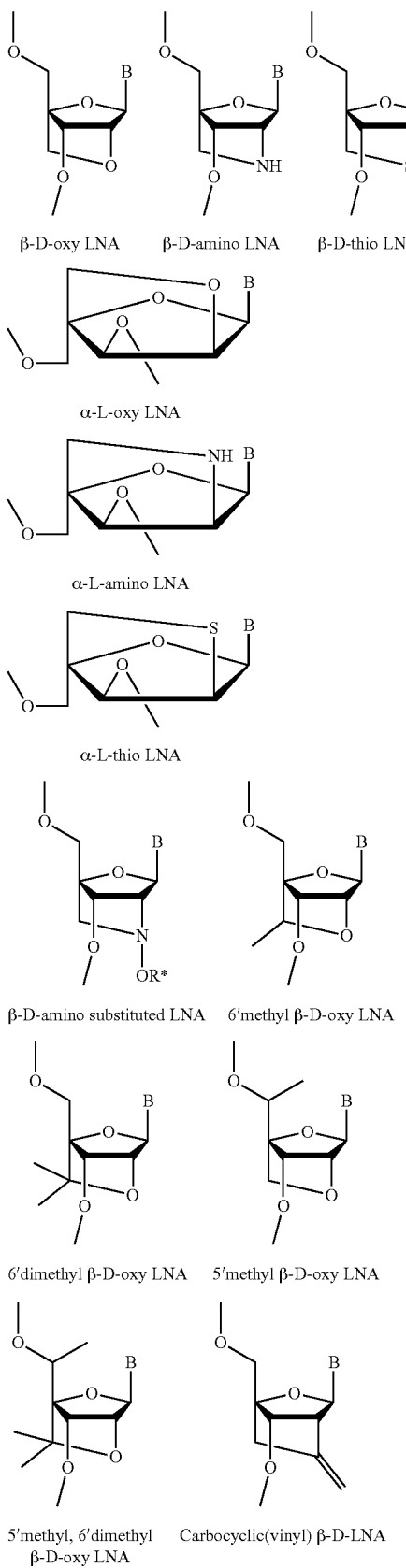

Particular LNA nucleosides are beta-D-oxy-LNA, 6'-methyl-beta-D-oxy LNA, such as (S)-6'-methyl-beta-D-oxy-LNA (ScET) and ENA.

A particularly advantageous LNA is beta-D-oxy-LNA.

The compounds described herein can contain several asymmetric centers and can be present in the form of optically pure enantiomers, mixtures of enantiomers such as, for example, racemates, mixtures of diastereoisomers, diastereoisomeric racemates or mixtures of diastereoisomeric racemates.

The term "asymmetric carbon atom" means a carbon atom with four different substituents. According to the Cahn-Ingold-Prelog Convention an asymmetric carbon atom can be of the "R" or "S" configuration.

Pharmaceutically Acceptable Salts

The term "pharmaceutically acceptable salts" refers to those salts which retain the biological effectiveness and properties of the free bases or free acids, which are not biologically or otherwise undesirable.

Protecting Group

The term "protecting group", alone or in combination, signifies a group which selectively blocks a reactive site in a multifunctional compound such that a chemical reaction can be carried out selectively at another unprotected reactive site. Protecting groups can be removed. Exemplary protecting groups are amino-protecting groups, carboxy-protecting groups or hydroxy-protecting groups.

Nuclease Mediated Degradation

Nuclease mediated degradation refers to an oligonucleotide capable of mediating degradation of a complementary nucleotide sequence when forming a duplex with such a sequence.

In some embodiments, the oligonucleotide may function via nuclease mediated degradation of the target nucleic acid, where the oligonucleotides of the invention are capable of recruiting a nuclease, particularly and endonuclease, preferably endoribonuclease (RNase), such as RNase H. Examples of oligonucleotide designs which operate via nuclease mediated mechanisms are oligonucleotides which typically comprise a region of at least 5 or 6 consecutive DNA nucleosides and are flanked on one side or both sides by affinity enhancing nucleosides, for example gapmers, headmers and tailmers.

RNase H Activity and Recruitment

The RNase H activity of an antisense oligonucleotide refers to its ability to recruit RNase H when in a duplex with a complementary RNA molecule. WO01/23613 provides in vitro methods for determining RNaseH activity, which may be used to determine the ability to recruit RNaseH.

Typically an oligonucleotide is deemed capable of recruiting RNase H if it, when provided with a complementary target nucleic acid sequence, has an initial rate, as measured in pmol/l/min, of at least 5%, such as at least 10% or more than 20% of the of the initial rate determined when using a oligonucleotide having the same base sequence as the modified oligonucleotide being tested, but containing only DNA monomers with phosphorothioate linkages between all monomers in the oligonucleotide, and using the methodology provided by Example 91-95 of WO01/23613 (hereby incorporated by reference). For use in determining RHase H activity, recombinant human RNase H1 is available from Lubio Science GmbH, Lucerne, Switzerland.

Gapmer

The antisense oligonucleotide of the invention, or contiguous nucleotide sequence thereof, may be a gapmer, also termed gapmer oligonucleotide or gapmer designs. The antisense gapmers are commonly used to inhibit a target nucleic acid via RNase H mediated degradation. A gapmer oligonucleotide comprises at least three distinct structural regions a 5'-flank, a gap and a 3'-flank, F-G-F' in the '5→3' orientation. The "gap" region (G) comprises a stretch of contiguous DNA nucleotides which enable the oligonucleotide to recruit RNase H. The gap region is flanked by a 5' flanking region (F) comprising one or more sugar modified nucleosides, advantageously high affinity sugar modified nucleosides, and by a 3' flanking region (F') comprising one or more sugar modified nucleosides, advantageously high affinity sugar modified nucleosides. The one or more sugar modified nucleosides in region F and F' enhance the affinity of the oligonucleotide for the target nucleic acid (i.e. are affinity enhancing sugar modified nucleosides). In some embodiments, the one or more sugar modified nucleosides in region F and F' are 2' sugar modified nucleosides, such as high affinity 2' sugar modifications, such as independently selected from LNA and 2'-MOE.

In a gapmer design, the 5' and 3' most nucleosides of the gap region are DNA nucleosides, and are positioned adjacent to a sugar modified nucleoside of the 5' (F) or 3' (F') region respectively.

The flanks may further defined by having at least one sugar modified nucleoside at the end most distant from the gap region, i.e. at the 5' end of the 5' flank and at the 3' end of the 3' flank.

Regions F-G-F' form a contiguous nucleotide sequence. Antisense oligonucleotides of the invention, or the contiguous nucleotide sequence thereof, may comprise a gapmer region of formula F-G-F'.

The overall length of the gapmer design F-G-F' may be, for example 12 to 32 nucleosides, such as 13 to 24, such as 14 to 22 nucleosides, Such as from 14 to 17, such as 16 to 18 nucleosides. By way of example, the gapmer oligonucleotide of the present invention can be represented by the following formulae:

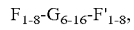

such as

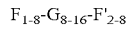

with the proviso that the overall length of the gapmer regions F-G-F' is at least 12, such as at least 14 nucleotides in length.

In an aspect of the invention the antisense oligonucleotide or contiguous nucleotide sequence thereof consists of or comprises a gapmer of formula 5'-F-G-F'-3', where region F and F' independently comprise or consist of 1-8, such as 2-6, such as 3-4 2' sugar modified nucleosides, wherein there is at least one 2' sugar modified nucleoside positioned at the 3' end of region F (adjacent to a DNA nucleoside of region G), and at least one 2' sugar modified nucleoside positioned at the 5' end of region F' (positioned adjacent to a DNA nucleoside of region G), and G is a region between 6 and 16 nucleosides which are capable of recruiting RNaseH, such as a region of 6-16 DNA nucleosides, such as such as 10-15 contiguous DNA nucleosides, such as 10-14 contiguous DNA nucleotides, such as 11-15 contiguous DNA nucleotides, such as 13-15 contiguous DNA nucleotides.

LNA Gapmer

An LNA gapmer is a gapmer wherein either one or both of region F and F' comprises or consists of LNA nucleosides. A beta-D-oxy gapmer is a gapmer wherein either one or both of region F and F' comprises or consists of beta-D-oxy LNA nucleosides.

In some embodiments the LNA gapmer is of formula: [LNA]$_{1-5}$-[region G]-[LNA]$_{1-5}$, wherein region G is as defined in the Gapmer region G definition.

Alternating Flank Gapmers

Flanking regions may comprise both LNA and DNA nucleoside and are referred to as "alternating flanks" as they comprise an alternating motif of LNA-DNA-LNA nucleosides. Gapmers comprising such alternating flanks are referred to as "alternating flank gapmers". "Alternative flank gapmers" are thus LNA gapmer oligonucleotides where at least one of the flanks (F or F') comprises DNA in addition to the LNA nucleoside(s). In some embodiments at least one of region F or F', or both region F and F', comprise both LNA nucleosides and DNA nucleosides. In such embodiments, the flanking region F or F', or both F and F' comprise at least three nucleosides, wherein the 5' and 3' most nucleosides of the F and/or F' region are LNA nucleosides.

An alternating flank region may comprise up to 3 contiguous DNA nucleosides, such as 1 to 2 or 1 or 2 or 3 contiguous DNA nucleosides.

Region D' or D" in an Oligonucleotide

The oligonucleotides disclosed herein may comprise or consist of the contiguous nucleotide sequence of the oligonucleotide which is complementary to the target nucleic acid, such as the gapmer F-G-F', and further 5' and/or 3' nucleosides. The further 5' and/or 3' nucleosides may or may not be fully complementary to the target nucleic acid. Such further 5' and/or 3' nucleosides may be referred to as region D' and D" herein.

The addition of region D' or D" may be used for the purpose of joining the contiguous nucleotide sequence, such as the gapmer, to a conjugate moiety or another functional group. When used for joining the contiguous nucleotide sequence with a conjugate moiety is can serve as a biocleavable linker. Alternatively it may be used to provide exonuclease protection or for ease of synthesis or manufacture.

Region D' and D" can be attached to the 5' end of region F or the 3' end of region F', respectively to generate designs of the following formulas D'-F-G-F', F-G-F'-D" or D'-F-G-F'-D". In this instance the F-G-F' is the gapmer portion of the oligonucleotide and region D' or D" constitute a separate part of the oligonucleotide.

Region D' or D" may independently comprise or consist of 1, 2, 3, 4 or 5 additional nucleotides, which may be complementary or non-complementary to the target nucleic acid. The nucleotide adjacent to the F or F' region is not a sugar-modified nucleotide, such as a DNA or RNA or base modified versions of these. The D' or D' region may serve as a nuclease susceptible biocleavable linker (see definition of linkers). In some embodiments the additional 5' and/or 3' end nucleotides are linked with phosphodiester linkages, and are DNA or RNA. Nucleotide based biocleavable linkers suitable for use as region D' or D" are disclosed in WO2014/076195, which include by way of example a phosphodiester linked DNA dinucleotide. The use of biocleavable linkers in poly-oligonucleotide constructs is disclosed in WO2015/113922, where they are used to link multiple antisense constructs (e.g. gapmer regions) within a single oligonucleotide.

In one embodiment the oligonucleotide of the invention comprises a region D' and/or D" in addition to the contiguous nucleotide sequence which constitutes the gapmer.

Oligonucleotide gapmers can be represented by the following formulae:

F-G-F'; in particular $F_{1-8}$-$G_{6-16}$-$F'_{2-8}$

D'-F-G-F', in particular $D'_{1-3}$-$F_{1-8}$-$G_{6-16}$-$F_{2-8}$

F-G-F'-D", in particular $F_{1-8}$-$G_{6-18}$-$F'_{2-8}$-$D"_{1-3}$

D'-F-G-F'-D", in particular $D'_{1-3}$-$F_{1-8}$-$G_{6-16}$-$F'_{2-8}$-$D"_{1-3}$ In some embodiments the internucleoside linkage positioned between region D' and region F is a phosphodiester linkage. In some embodiments the internucleoside linkage positioned between region F' and region D" is a phosphodiester linkage.

Conjugate

The term conjugate as used herein refers to an oligonucleotide which is covalently linked to a non-nucleotide moiety (conjugate moiety or region C or third region).

Conjugation of the oligonucleotide of the invention to one or more non-nucleotide moieties may improve the pharmacology of the oligonucleotide, e.g. by affecting the activity, cellular distribution, cellular uptake or stability of the oligonucleotide. In some embodiments the conjugate moiety modify or enhance the pharmacokinetic properties of the oligonucleotide by improving cellular distribution, bioavailability, metabolism, excretion, permeability, and/or cellular uptake of the oligonucleotide. In particular, the conjugate may target the oligonucleotide to a specific organ, tissue or cell type and thereby enhance the effectiveness of the oligonucleotide in that organ, tissue or cell type. At the same time the conjugate may serve to reduce activity of the oligonucleotide in non-target cell types, tissues or organs, e.g. off target activity or activity in non-target cell types, tissues or organs.

In an embodiment, the non-nucleotide moiety (conjugate moiety) is selected from the group consisting of carbohydrates, cell surface receptor ligands, drug substances, hormones, lipophilic substances, polymers, proteins, peptides, toxins (e.g. bacterial toxins), vitamins, viral proteins (e.g. capsids) or combinations thereof.

In some embodiments, the conjugate is an antibody or an antibody fragment which has a specific affinity for a transferrin receptor, for example as disclosed in WO 2012/143379 herby incorporated by reference. In some embodiments the non-nucleotide moiety is an antibody or antibody fragment, such as an antibody or antibody fragment that facilitates delivery across the blood-brain-barrier, in particular an antibody or antibody fragment targeting the transferrin receptor.

Linkers

A linkage or linker is a connection between two atoms that links one chemical group or segment of interest to another chemical group or segment of interest via one or more covalent bonds. Conjugate moieties can be attached to the oligonucleotide directly or through a linking moiety (e.g. linker or tether). Linkers serve to covalently connect a third region, e.g. a conjugate moiety (Region C), to a first region, e.g. an oligonucleotide or contiguous nucleotide sequence complementary to the target nucleic acid (region A).

In some embodiments of the invention the conjugate or oligonucleotide conjugate of the invention may optionally, comprise a linker region (second region or region B and/or region Y) which is positioned between the oligonucleotide or contiguous nucleotide sequence complementary to the target nucleic acid (region A or first region) and the conjugate moiety (region C or third region).

Region B refers to biocleavable linkers comprising or consisting of a physiologically labile bond that is cleavable under conditions normally encountered or analogous to those encountered within a mammalian body. Conditions under which physiologically labile linkers undergo chemical transformation (e.g., cleavage) include chemical conditions such as pH, temperature, oxidative or reductive conditions or agents, and salt concentration found in or analogous to those encountered in mammalian cells. Mammalian intracellular conditions also include the presence of enzymatic activity normally present in a mammalian cell such as from proteolytic enzymes or hydrolytic enzymes or nucleases. In one embodiment the biocleavable linker is susceptible to S1 nuclease cleavage. In a preferred embodiment the nuclease susceptible linker comprises between 1 and 10 nucleosides, such as 1, 2, 3, 4, 5, 6, 7, 8, 9 or 10 nucleosides, more preferably between 2 and 6 nucleosides and most preferably between 2 and 4 linked nucleosides comprising at least two consecutive phosphodiester linkages, such as at least 3 or 4 or 5 consecutive phosphodiester linkages. Preferably the nucleosides are DNA or RNA. Phosphodiester containing biocleavable linkers are described in more detail in WO 2014/076195 (hereby incorporated by reference)—see also region D' or D" herein.

Region Y refers to linkers that are not necessarily biocleavable but primarily serve to covalently connect a conjugate moiety (region C or third region), to an oligonucleotide (region A or first region). The region Y linkers may comprise a chain structure or an oligomer of repeating units such as ethylene glycol, amino acid units or amino alkyl groups The oligonucleotide conjugates of the present invention can be constructed of the following regional elements A-C, A-B-C, A-B-Y-C, A-Y-B-C or A-Y-C. In some embodiments the linker (region Y) is an amino alkyl, such as a C2-C36 amino alkyl group, including, for example C6 to C12 amino alkyl groups. In a preferred embodiment the linker (region Y) is a C6 amino alkyl group.

Treatment

The term 'treatment' as used herein refers to both treatment of an existing disease (e.g. a disease or disorder as herein referred to), or prevention of a disease, i.e. prophylaxis. It will therefore be recognized that treatment as referred to herein may, in some embodiments, be prophylactic.

In some embodiments treatment is performed on a patient who has been diagnosed with a neurological disorder, such as a neurological disorder selected from the group consisting of neurodegenerative diseases including spinocerebellar ataxia type 2 (SCA2), amyotrophic lateral sclerosis (ALS), Alzheimer's frontotemporal dementia (FTD), parkinsonism and conditions with TDP-43 proteinopathies.

In some embodiments the compounds of the invention are for use in the treatment of spinocerebellar ataxia type 2 (SCA2) or amyotrophic lateral sclerosis (ALS).

DETAILED DESCRIPTION OF THE INVENTION

The Oligonucleotides of the Invention

The invention provides for an antisense oligonucleotide of formula (SEQ ID NO 15_4)
TCAcAttttactttaacCTC wherein capital letters are beta-D-oxy LNA nucleosides, lowercase letters are DNA nucleosides, all LNA C are 5-methyl cytosine, all internucleoside linkages are phosphorothioate internucleoside linkages.

conjugate moiety is a conjugate that facilitates delivery across the blood brain barrier, such as an antibody or antibody fragment targeting the transferrin receptor.

Method of Manufacture

In a further aspect, the invention provides methods for manufacturing the oligonucleotides of the invention comprising reacting nucleotide units and thereby forming covalently linked contiguous nucleotide units comprised in the oligonucleotide. Preferably, the method uses phophoramidite chemistry (see for example Caruthers et al, 1987, Methods in Enzymology vol. 154, pages 287-313). In a further embodiment the method further comprises reacting the contiguous nucleotide sequence with a conjugating moi-

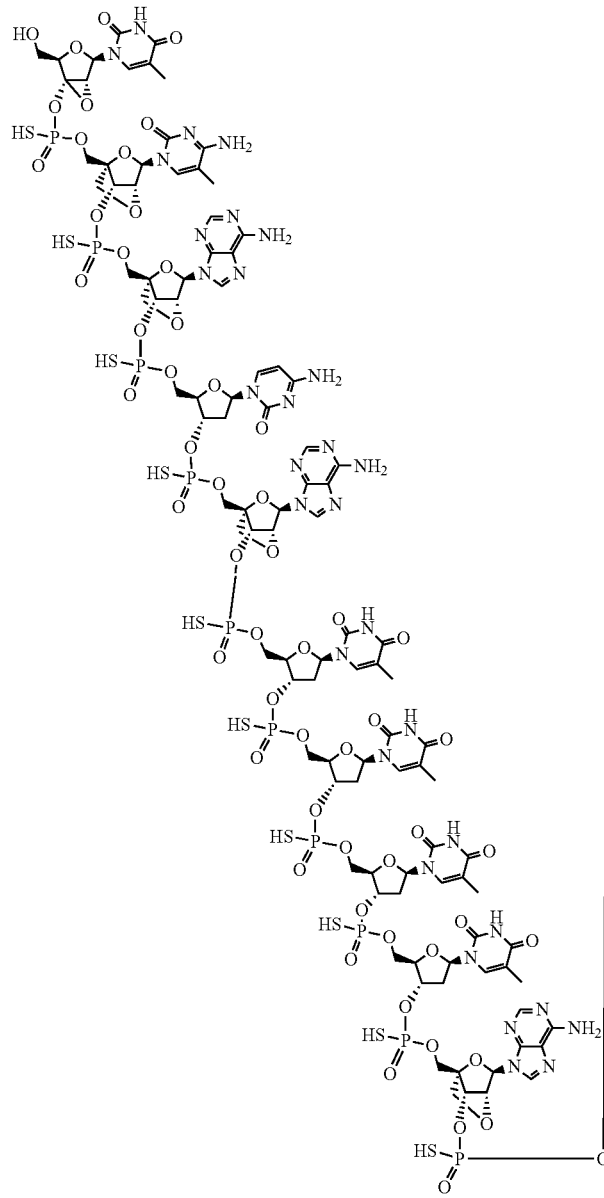
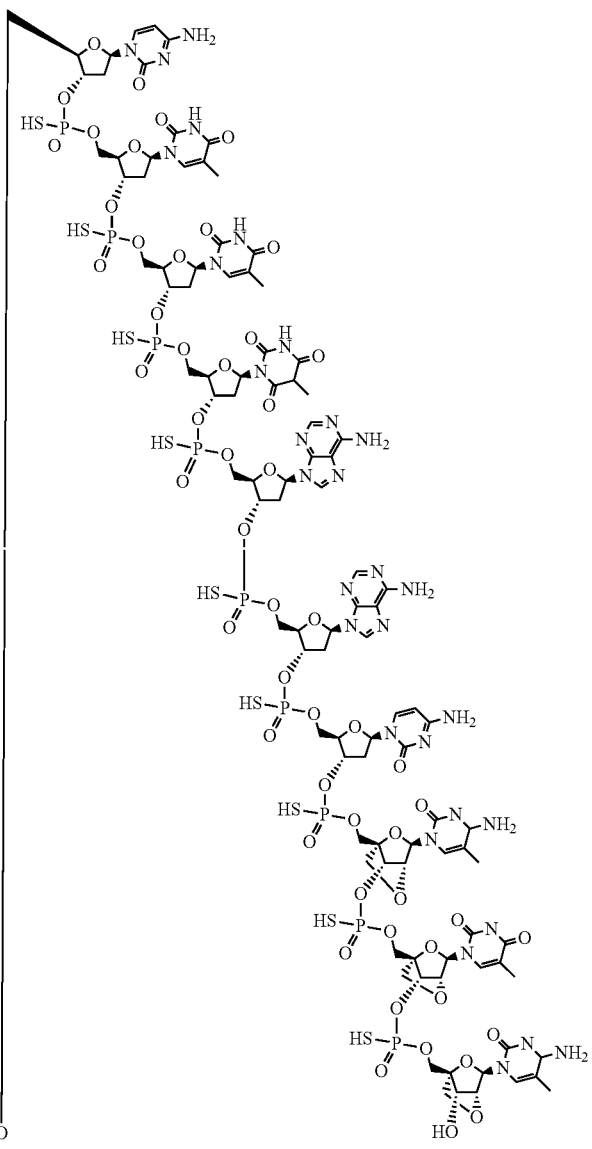

The invention provides a conjugate comprising the oligonucleotide or antisense oligonucleotide according to the invention, and at least one conjugate moiety covalently attached to said oligonucleotide. In some embodiments the conjugate moiety is a conjugate that facilitates delivery across the blood brain barrier, such as an antibody or antibody fragment targeting the transferrin receptor.

ety (ligand) to covalently attach the conjugate moiety to the oligonucleotide. In a further aspect a method is provided for manufacturing the composition of the invention, comprising mixing the oligonucleotide or conjugated oligonucleotide of the invention with a pharmaceutically acceptable diluent, solvent, carrier, salt and/or adjuvant.

Pharmaceutical Salt

In a further aspect the invention provides a pharmaceutically acceptable salt of the antisense oligonucleotide or a conjugate thereof. In a preferred embodiment, the pharmaceutically acceptable salt is a sodium or a potassium salt.

Pharmaceutical Composition

In a further aspect, the invention provides pharmaceutical compositions comprising any of the aforementioned oligonucleotides and/or oligonucleotide conjugates or salts thereof and a pharmaceutically acceptable diluent, carrier, salt and/or adjuvant. A pharmaceutically acceptable diluent includes phosphate-buffered saline (PBS) and pharmaceutically acceptable salts include, but are not limited to, sodium and potassium salts. In some embodiments the pharmaceutically acceptable diluent is sterile phosphate buffered saline. In some embodiments the oligonucleotide is used in the pharmaceutically acceptable diluent at a concentration of 50-300 µM solution.

Suitable formulations for use in the present invention are found in Remington's Pharmaceutical Sciences, Mack Publishing Company, Philadelphia, Pa., 17th ed., 1985. For a brief review of methods for drug delivery, see, e.g., Langer (Science 249:1527-1533, 1990). WO 2007/031091 provides further suitable and preferred examples of pharmaceutically acceptable diluents, carriers and adjuvants (hereby incorporated by reference). Suitable dosages, formulations, administration routes, compositions, dosage forms, combinations with other therapeutic agents, pro-drug formulations are also provided in WO2007/031091.

Oligonucleotides or oligonucleotide conjugates of the invention may be mixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

These compositions may be sterilized by conventional sterilization techniques, or may be sterile filtered. The resulting aqueous solutions may be packaged for use as is, or lyophilized, the lyophilized preparation being combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of the above-mentioned agent or agents, such as in a sealed package of tablets or capsules. The composition in solid form can also be packaged in a container for a flexible quantity, such as in a squeezable tube designed for a topically applicable cream or ointment.

In some embodiments, the oligonucleotide or oligonucleotide conjugate of the invention is a prodrug. In particular, with respect to oligonucleotide conjugates the conjugate moiety is cleaved off the oligonucleotide once the prodrug is delivered to the site of action, e.g. the target cell.

Applications

The oligonucleotides of the invention may be utilized as research reagents for, for example, diagnostics, therapeutics and prophylaxis.

In research, such oligonucleotides may be used to specifically modulate the synthesis of Ataxin2 protein in cells (e.g. in vitro cell cultures) and experimental animals thereby facilitating functional analysis of the target or an appraisal of its usefulness as a target for therapeutic intervention. Typically the target modulation is achieved by degrading or inhibiting the mRNA producing the protein, thereby prevent protein formation or by degrading or inhibiting a modulator of the gene or mRNA producing the protein.

If employing the oligonucleotide of the invention in research or diagnostics the target nucleic acid may be a cDNA or a synthetic nucleic acid derived from DNA or RNA.

The present invention provides an in vivo or in vitro method for modulating ATXN2 expression in a target cell which is expressing ATXN2, said method comprising administering an oligonucleotide of the invention in an effective amount to said cell.

In some embodiments, the target cell, is a mammalian cell in particular a human cell. The target cell may be an in vitro cell culture or an in vivo cell forming part of a tissue in a mammal. In preferred embodiments the target cell is present in the brain or central nervous system, including the brainstem and the spinal cord. In particular cells in the cerebellum are relevant target cells, such as purkinje neurons or purkinje cells, in particular in an individual affected by spinocerebellar ataxia type 2 (SCA2).

Other relevant target cells are motor neurons located in the cortex of the brain and in spinal cord. Upper motor neurons in the motor cortex, as well as lower motor neurons in the brain stem and spinal cord are target cells of the present invention. In particular motor neurons in an individual affected by amyotrophic lateral sclerosis (ALS) are relevant target cells.

In diagnostics the oligonucleotides may be used to detect and quantitate ATXN2 expression in cell and tissues by northern blotting, in-situ hybridization or similar techniques.

For therapeutics, the oligonucleotides may be administered to an animal or a human, suspected of having a disease or disorder, which can be treated by modulating the expression of ATXN2.

The invention provides methods for treating or preventing a disease, comprising administering a therapeutically or prophylactically effective amount of an oligonucleotide, an oligonucleotide conjugate or a pharmaceutical composition of the invention to a subject suffering from or susceptible to the disease.

The invention also relates to an oligonucleotide, a composition or a conjugate as defined herein for use as a medicament.

The oligonucleotide, oligonucleotide conjugate or a pharmaceutical composition according to the invention is typically administered in an effective amount.

The invention also provides for the use of the oligonucleotide or oligonucleotide conjugate of the invention as described for the manufacture of a medicament for the treatment of a disorder as referred to herein, or for a method of the treatment of as a disorder as referred to herein.

The disease or disorder, as referred to herein, is associated with expression of ATXN2. In some embodiments disease or disorder may be associated with a mutation in the ATXN2 gene, such an expanded CAG repeat region. The disease or disorder may be associated with a gene whose protein product is associated with or interacts with ATXN2. In particular in diseases associated with TDP-43 proteinopathies the reduction of ATXN2 may have a beneficial effect, e.g. in amyotrophic lateral sclerosis (ALS), Alzheimer's, frontotemporal dementia (FTD), and parkinsonism.

The methods of the invention are preferably employed for treatment or prophylaxis against diseases caused by abnormal levels and/or activity of ATXN2.

The invention further relates to use of an oligonucleotide, oligonucleotide conjugate or a pharmaceutical composition as defined herein for the manufacture of a medicament for the treatment of abnormal levels and/or activity of ATXN2.

In one embodiment, the invention relates to oligonucleotides, oligonucleotide conjugates or pharmaceutical compositions for use in the treatment of diseases or disorders selected from neurodegenerative diseases including spinocerebellar ataxia type 2 (SCA2), amyotrophic lateral sclerosis (ALS), Alzheimer's disease, frontotemporal dementia (FTD), parkinsonism and conditions with TDP-43 proteinopathies. In particular the use of the oligonucleotides, oligonucleotide conjugates or pharmaceutical compositions of the invention in the treatment of spinocerebellar ataxia type 2 (SCA2) or amyotrophic lateral sclerosis (ALS) is advantageous.

Administration

The oligonucleotides or pharmaceutical compositions of the present invention may be administered via parenteral (such as, intravenous, subcutaneous, intra-muscular, intracerebral, intracerebroventricular intraocular, or intrathecal administration).

In some embodiments, the administration is via intrathecal administration.

Advantageously, e.g. for treatment of neurological disorders, the oligonucleotide or pharmaceutical compositions of the present invention are administered intrathecally or intracranially, e.g. via intracerebral or intraventricular administration.

The invention also provides for the use of the oligonucleotide or conjugate thereof, such as pharmaceutical salts or compositions of the invention, for the manufacture of a medicament wherein the medicament is in a dosage form for subcutaneous administration.

The invention also provides for the use of the oligonucleotide of the invention, or conjugate thereof, such as pharmaceutical salts or compositions of the invention, for the manufacture of a medicament wherein the medicament is in a dosage form for intrathecal administration.

The invention also provides for the use of the oligonucleotide or oligonucleotide conjugate of the invention as described for the manufacture of a medicament wherein the medicament is in a dosage form for intrathecal administration.

Combination Therapies

In some embodiments the oligonucleotide, oligonucleotide conjugate or pharmaceutical composition of the invention is for use in a combination treatment with another therapeutic agent. The therapeutic agent can for example be the standard of care for the diseases or disorders described above.

EXAMPLES

Materials and Methods

Oligonucleotide Motif Sequences and Oligonucleotide Compounds

TABLE 4 list of oligonucleotide motif sequences (indicated by SEQ ID NO), designs of these, as well as specific oligonucleotide compounds (indicated by CMP ID NO) designed based on the motif sequence.

| SEQ ID NO | Motif sequence | position on SEQ ID NO: 1 Start | end | Design | CMP ID NO | Oligonucleotide Compound |
|---|---|---|---|---|---|---|
| 7 | attttactttaacctcc | 83122 | 83138 | 4-10-3 | 7_1 | ATTTtactttaaccTCC |
| 8 | cattttactttaacctcc | 83122 | 83139 | 4-12-2 | 8_1 | CATTttactttaacctCC |
| 9 | cattttactttaacctcct | 83121 | 83139 | 2-15-2 | 9_1 | CAttttactttaacctcCT |
| 10 | acattttactttaacctcc | 83122 | 83140 | 3-14-2 | 10_1 | ACAttttactttaacctCC |
| 11 | cacattttactttaacctc | 83123 | 83141 | 3-13-3 | 11_1 | CACattttactttaacCTC |
| 12 | cacattttactttaacct | 83124 | 83141 | 3-12-3 | 12_1 | CACattttactttaaCCT |
| 13 | tcacattttactttaacct | 83124 | 83142 | 4-13-2 | 13_1 | TCACattttactttaacCT |
| 14 | tcacattttactttaacc | 83125 | 83142 | 4-10-4 | 14_1 | TCACattttactttAACC |
| 15 | tcacattttactttaacctc | 83123 | 83142 | 4-14-2 | 15_1 | TCACattttactttaaccTC |
| 16 | ttcacattttactttaacct | 83124 | 83143 | 4-14-2 | 16_1 | TTCAcattttactttaacCT |
| 17 | ttcacattttactttaac | 83126 | 83143 | 4-10-4 | 17_1 | TTCAcattttactttTAAC |
| 18 | ttcacattttactttaacc | 83125 | 83143 | 4-12-3 | 18_1 | TTCAcattttactttaACC |
| 19 | attcacattttactttaac | 83126 | 83144 | 4-11-4 | 19_1 | ATTCacattttactttTAAC |
| 20 | attttactttaacctcc | 83122 | 83138 | 3-11-3 | 20_1 | ATTttactttaaccTCC |
| 21 | cattttactttaacctcc | 83122 | 83139 | 2-14-2 | 21_1 | CAttttactttaacctCC |
| 22 | cacattttactttaacctc | 83123 | 83141 | 2-14-3 | 22_1 | CAcattttactttaacCTC |
| 23 | cacattttactttaacct | 83124 | 83141 | 4-12-2 | 23_1 | CACAttttactttaacCT |

TABLE 4 -continued list of oligonucleotide motif sequences (indicated by SEQ ID NO),
designs of these, as well as specific oligonucleotide compounds
(indicated by CMP ID NO) designed based on the motif sequence.

| SEQ ID NO | Motif sequence | position on SEQ ID NO: 1 Start | end | Design NO | CMP ID | Oligonucleotide Compound |
|---|---|---|---|---|---|---|
| 24 | tcacattttactttaacct | 83124 | 83142 | 3-14-2 | 24_1 | TCAcattttactttaacCT |
| 25 | tcacattttactttaacc | 83125 | 83142 | 3-12-3 | 25_1 | TCAcattttactttaACC |
| 26 | tcacattttactttaacctc | 83123 | 83142 | 2-16-2 | 26_1 | TCacattttactttaaccTC |
| 27 | ttcacattttactttaacct | 83124 | 83143 | 3-15-2 | 27_1 | TTCacattttactttaacCT |
| 28 | ttcacattttactttaacc | 83125 | 83143 | 3-13-3 | 28_1 | TTCacattttactttaACC |
| 29 | attcacattttactttaacc | 83125 | 83144 | 3-15-2 | 29_1 | ATTcacattttactttaaCC |
| 30 | attttactttaacctcc | 83122 | 83138 | 2-12-3 | 30_1 | ATtttactttaaccTCC |
| 31 | acattttactttaacctcc | 83122 | 83140 | 2-15-2 | 31_1 | ACattttactttaacctCC |
| 32 | cacattttactttaacctc | 83123 | 83141 | 3-14-2 | 32_1 | CACattttactttaaccTC |
| 33 | tcacattttactttaacc | 83125 | 83142 | 2-12-4 | 33_1 | TCacattttactttAACC |
| 34 | ttcacattttactttaacc | 83125 | 83143 | 3-14-2 | 34_1 | TTCacattttactttaaCC |
| 35 | attcacattttactttaacc | 83125 | 83144 | 2-15-3 | 35_1 | ATtcacattttactttaACC |

Motif sequences represent the contiguous sequence of nucleobases present in the oligonucleotide.

Design refers to the gapmer design, F-G-F', where each number represents the number of consecutive modified nucleosides, e.g. 2' modified nucleosides (first number=5' flank), followed by the number of DNA nucleosides (second number=gap region), followed by the number of modified nucleosides, e.g. 2' modified nucleosides (third number=3' flank), optionally preceded by or followed by further repeated regions of DNA and LNA, which are not necessarily part of the contiguous nucleotide sequence that is complementary to the target nucleic acid.

Oligonucleotide compound represent specific designs of a motif sequence. Capital letters represent beta-D-oxy LNA nucleosides, lowercase letters represent DNA nucleosides, all LNA C are 5-methyl cytosine, and 5-methyl DNA cytosines are presented by "e", all internucleoside linkages are phosphorothioate internucleoside linkages.

Oligonucleotide Synthesis

Oligonucleotide synthesis is generally known in the art. Below is a protocol which may be applied. The oligonucleotides of the present invention may have been produced by slightly varying methods in terms of apparatus, support and concentrations used.

Oligonucleotides are synthesized on uridine universal supports using the phosphoramidite approach on an Oligomaker 48 at 1 µmol scale. At the end of the synthesis, the oligonucleotides are cleaved from the solid support using aqueous ammonia for 5-16 hours at 60° C. The oligonucleotides are purified by reverse phase HPLC (RP-HPLC) or by solid phase extractions and characterized by UPLC, and the molecular mass is further confirmed by ESI-MS.

Elongation of the Oligonucleotide:

The coupling of β-cyanoethyl-phosphoramidites (DNA-A(Bz), DNA-G(ibu), DNA-C(Bz), DNA-T, LNA-5-methyl-C(Bz), LNA-A(Bz), LNA-G(dmf), or LNA-T) is performed by using a solution of 0.1 M of the 5'-O-DMT-protected amidite in acetonitrile and DCI (4,5-dicyanoimidazole) in acetonitrile (0.25 M) as activator. For the final cycle a phosphoramidite with desired modifications can be used, e.g. a C6 linker for attaching a conjugate group or a conjugate group as such. Thiolation for introduction of phosphorthioate linkages is carried out by using xanthane hydride (0.01 M in acetonitrile/pyridine 9:1). Phosphodiester linkages can be introduced using 0.02 M iodine in THF/Pyridine/water 7:2:1. The rest of the reagents are the ones typically used for oligonucleotide synthesis.

For post solid phase synthesis conjugation a commercially available C6 aminolinker phosphoramidite can be used in the last cycle of the solid phase synthesis and after deprotection and cleavage from the solid support the aminolinked deprotected oligonucleotide is isolated. The conjugates are introduced via activation of the functional group using standard synthesis methods.

Purification by RP-HPLC:

The crude compounds are purified by preparative RP-HPLC on a Phenomenex Jupiter C18 10µ150×10 mm column. 0.1 M ammonium acetate pH 8 and acetonitrile is used as buffers at a flow rate of 5 mL/min. The collected fractions are lyophilized to give the purified compound typically as a white solid.

Abbreviations:
DCI: 4,5-Dicyanoimidazole
DCM: Dichloromethane
DMF: Dimethylformamide
DMT: 4,4'-Dimethoxytrityl
THF: Tetrahydrofurane
Bz: Benzoyl
Ibu: Isobutyryl
RP-HPLC: Reverse phase high performance liquid chromatography
$T_m$ Assay:
Oligonucleotide and RNA target (phosphate linked, PO) duplexes are diluted to 3 mM in 500 ml RNase-free water and mixed with 500 ml 2×$T_m$-buffer (200 mM NaCl, 0.2 mM EDTA, 20 mM Naphosphate, pH 7.0). The solution is heated to 95° C. for 3 min and then allowed to anneal in room temperature for 30 min. The duplex melting temperatures ($T_m$) is measured on a Lambda 40 UV/VIS Spectrophotometer equipped with a Peltier temperature programmer PTP6 using PE Templab software (Perkin Elmer). The temperature is ramped up from 20° C. to 95° C. and then down to 25° C., recording absorption at 260 nm. First derivative and the local maximums of both the melting and annealing are used to assess the duplex $T_m$.

Cell Lines supplier (see Table 5 in the Materials and Methods section). The number of cells/well has been optimized for each cell line (see Table 5 in the Materials and Methods section).

Cells were incubated between 0 and 24 hours before addition of the oligonucleotide in concentration of 5 or 25 µM (dissolved in PBS). 3-4 days after addition of the oligonucleotide, the cells were harvested (The incubation times for each cell line are indicated in Table 5 in the Materials and Methods section).

RNA was extracted using the Qiagen RNeasy 96 kit (74182), according to the manufacturer's instructions). cDNA synthesis and qPCR was performed using qScript

TABLE 5

Details in relation to the cell lines used in Example 1 and 2

| Cell lines | | | | Cells/well (96 well plate) | Hours of cell Incubation prior to treatment | Days of treatment |
|---|---|---|---|---|---|---|
| Name | Vendor | Cat. no. | Cell medium | | | |
| A431 | ECACC | 85090402 | EMEM (Cat. no. M2279), 10% FBS (Cat. no. F7524), 2 mM Glutamine (Cat. no. G8541), 0.1 mM NEAA (Cat. no. M7145), 25 µg/ml Gentamicin (Cat. no. G1397) | 8000 | 24 | 3 |
| NCI-H23 | ATCC | CRL-5800 | RPMI 1640 (Cat. no. R2405), 10% FBS (Cat. no. F7524), 10 mM Hepes (Cat. no. H0887), 1 mM Sodium Pyruvate (Cat. no. S8636), 25 µg/ml Gentamicin (Cat. no. G1397) | 10000 | 24 | 3 |
| ARPE19 | ATCC | CRL-2302 | DMEM/F-12 HAM (Cat. no. D8437), 10% FBS (Cat. no. F7524), 25 µg/ml Gentamicin (Cat. no. G1397) | 2000 | 0 | 4 |
| U251 | ECACC | 9063001 | EMEM (Cat. no. M2279), 10% FBS (Cat. no. F7524), 2 mM Glutamine (Cat. no. G8541), 0.1 mM NEAA (Cat. no. M7145), 1 mM Sodium Pyruvate (Cat. no. S8636), 25 µg/ml Gentamicin (Cat. no. G1397) | 2000 | 0 | 4 |
| U2-OS | ATCC | HTB-96 | MCCoy 5A medium (Cat. no. M8403), 10% FBS (Cat. no. F7524), 1.5 mM Glutamine (Cat. no. G8541), 25 µg/ml Gentamicin (Cat. no. G13971 | 7000 | 24 | 3 |

* All medium and additives were purchased from Sigma Aldrich

Example 1 Testing In Vitro Efficacy of LNA Oligonucleotides in A431, NCI-H23 and ARPE19 Cell Lines at 25 and 5 µM An oligonucleotide screen was done in three human cell lines using the LNA oligonucleotides in Table 4 targeting the region from position 83121 to 83144 of SEQ ID NO: 1. The human cell lines A341, NCI-H23 and ARPE19 were purchased from the vendors listed in Table 5, maintained as recommended by the supplier in a humidified incubator at 37° C. with 5% CO2. For the screening assays, cells were seeded in 96 multi well plates in media recommended by the XLT one-step RT-qPCR ToughMix Low ROX, 95134-100 (Quanta Biosciences). Target transcript levels were quantified using FAM labeled TaqMan assays from Thermo Fisher Scientific in a multiplex reaction with a VIC labelled GUSB control. TaqMan primer assays for the target transcript of interest ATXN2 (Hs01002833_m1(FAM-MGB)), and a house keeping gene GUSB (4326320E VIC-MGB probe). A technical duplex set up was used, n=1 biological replicate.

The relative ATXN2 mRNA expression levels are shown in Table 6 as % of control (PBS-treated cells) i.e. the lower the value the larger the inhibition.

TABLE 6 in vitro efficacy of anti-ATXN2 compounds (single experiment with duplex qPCR).
ATXN2 mRNA levels are normalized to GUSB and shown as % of control (PBS treated cells).

| CMP ID NO | Compound | ARPE19 Residual mRNA level, % of ctrl 25 μM | 5 μM | NCI-H23 Residual mRNA level, % of ctrl 25 μM | 5 μM | A431 Residual mRNA level, % of ctrl 25 μM | 5 μM |
|---|---|---|---|---|---|---|---|
| 7_1 | ATTTtctttatttaccTCC | 20 | 38 | 7 | 14 | 2 | 3 |
| 8_1 | CATTttactttaacctCC | 43 | 56 | 14 | 32 | 2 | 4 |
| 9_1 | CAttttactttaacctcCT | 93 | 102 | 77 | 99 | 66 | 70 |
| 10_1 | ACAttttactttaacctCC | 68 | 84 | 36 | 57 | 10 | 21 |
| 11_1 | CACattttactttaacCTC | 22 | 48 | 8 | 21 | 1 | 2 |
| 12_1 | CACattttactttaaCCT | 42 | 62 | 14 | 29 | 2 | 3 |
| 13_1 | TCACattttactttaacCT | 26 | 44 | 8 | 17 | 3 | 3 |
| 14_1 | TCACattttactttAACC | 14 | 37 | 4 | 6 | 3 | 10 |
| 15_1 | TCACattttactttaccTC | 14 | 31 | 5 | 11 | 2 | 7 |
| 16_1 | TTCAcattttactttaacCT | 34 | 48 | 12 | 22 | 2 | 10 |
| 17_1 | TTCAcattttactttTAAC | 29 | 51 | 9 | 17 | 3 | 8 |
| 18_1 | TTCAcattttactttaACC | 21 | 47 | 6 | 14 | 2 | 2 |
| 19_1 | ATTCacattttactttTAAC | 39 | 72 | 12 | 24 | 4 | 6 |
| 20_1 | ATTttactttaaccTCC | 25 | 56 | 12 | 25 | 2 | 3 |
| 21_1 | CAttttatttctttaacctCC | 73 | 88 | 61 | 76 | 41 | 65 |
| 22_1 | CAcattttactttaacCTC | 57 | 79 | 35 | 59 | 9 | 16 |
| 23_1 | CACAttttactttaacCT | 56 | 77 | 23 | 44 | 8 | 13 |
| 24_1 | TCAcattttactttaacCT | 72 | 87 | 39 | 60 | 16 | 25 |
| 25_1 | TCAcattttactttaACC | 43 | 61 | 14 | 32 | 4 | 6 |
| 26_1 | TCacattttactttaaccTC | 72 | 97 | 53 | 80 | 25 | 37 |
| 27_1 | TTCacattttactttaacCT | 54 | 78 | 33 | 51 | 10 | 17 |
| 28_1 | TTCacattttactttaACC | 35 | 59 | 13 | 26 | 3 | 5 |
| 29_1 | ATTcacaffftactttaaCC | 78 | 99 | 71 | 86 | 52 | 69 |
| 30_1 | ATtttactttaaccTCC | 52 | 55 | 25 | 51 | 4 | 8 |
| 31_1 | ACattttactttaacctCC | 69 | 60 | 49 | 70 | 18 | 29 |
| 32_1 | CACattttactttaaccTC | 50 | 67 | 24 | 44 | 5 | 8 |
| 33_1 | TCacattttactttAACC | 51 | 76 | 22 | 44 | 4 | 9 |
| 34_1 | TTCacattttactttaaCC | 72 | 84 | 39 | 63 | 12 | 27 |
| 35_1 | ATcacattttactttaACC | 101 | 102 | 94 | 95 | 103 | 114 |

Example 2, Testing In Vitro EC50 and Efficacy of Selected Compounds from Example 1 in A431, NCI-H23, U251 and U2-OS Cell Lines The EC50 and efficacy (KD) of the oligonucleotides from Example 1 showing less than 20% residual ATXN2 mRNA in NCI-H23 cells at 5 μM was determined using the assay described in example 1 with the following oligonucleotide concentrations 50, 15.81, 5.00, 1.58, 0.50, 0.16, 0.05, and 0.016 μM (half-log dilution, 8 points from 50 μM), and n=1-2 biological replicates.

The conditions for the two additional cell lines are shown in Table 5 in the Materials and Methods section and the TaqMan primer assay used for cell line U2-OS are ATXN2, Hs00268077_m1 (FAM-MGB) and housekeeping GAPDH, 4326137E (VIC-MGB). The TaqMan primers for the cell lines used in Example 1 were identical in this example.

The EC50 value was calculated using GraphPad Prism6 and the maximum reduction of ATXN2 mRNA at 50 μM (Max KD) is shown in the table as % of control (PBS-treated cells). The results are presented for each cell line in tables 7-10.

TABLE 7 in vitro EC50 and Max efficacy of anti-ATXN2 compounds in A431 cells. ATXN2 mRNA levels are normalized to GUSB shown as % of control (PBS treated cells). The experiment was performed in duplex (sample A and B)

| CMP ID NO | Compound | EC50 [μM] A | EC50 [μM] B | mRNA level [% of ctrl] A | mRNA level [% of ctrl] B |
|---|---|---|---|---|---|
| 7_1 | ATTTtctttaaccTCC | 0.11 | 0.12 | 5 | 7 |
| 13_1 | TCACattttactttaacCT | 0.29 | 0.29 | 6 | 6 |
| 14_1 | TCACattttactttAACC | 0.07 | 0.08 | 7 | 7 |
| 15_1 | TCACattttactttaaccTC | 0.14 | 0.11 | 4 | 4 |
| 17_1 | TTCAcattttactTTAAC | 0.22 | 0.26 | 10 | 9 |
| 18_1 | TTCAcattttactttaACC | 0.16 | 0.17 | 5 | 5 |

TABLE 8 in vitro EC50 and Max efficacy of anti-ATXN2 compounds in NCI-H23 cells. ATXN2 mRNA levels are normalized to GUSB shown as % of control (PBS treated cells). The experiment was performed in duplex (sample A and B)

| CMP ID NO | Compound | EC50 [μM] A | EC50 [μM] B | mRNA level [% of ctrl] A | mRNA level [% of ctrl] B |
|---|---|---|---|---|---|
| 7_1 | ATTTtactttaaccTCC | 0.18 | 0.30 | 8 | 8 |
| 13_1 | TCACattttactttaacCT | 0.34 | 0.55 | 8 | 10 |
| 14_1 | TCACattttactttAACC | 0.14 | 0.20 | 5 | 7 |
| 15_1 | TCACattttactttaaccTC | 0.22 | 0.34 | 8 | 9 |
| 17_1 | TTCAcattttacttTAAC | 0.35 | 0.35 | 10 | 11 |
| 18_1 | TTCAcattttactttaACC | 0.39 | 0.33 | 7 | 8 |

TABLE 9 in vitro EC50 and Max efficacy of anti-ATXN2 compounds in U251 cells. ATXN2 mRNA levels are normalized to GUSB shown as % of control (PBS treated cells). The experiment was performed in duplex (sample A and B)

| CMP ID NO | Compound | EC50 [μM] A | EC50 [μM] B | mRNA level [% of ctrl] A | mRNA level [% of ctrl] B |
|---|---|---|---|---|---|
| 7_1 | ATTTtactttaaccTCC | 1.63 | 1.33 | 6 | 5 |
| 13_1 | TCACattttactttaacCT | 1.87 | 2.22 | 5 | 5 |
| 14_1 | TCACattttactttAACC | 1.02 | 1.21 | 4 | 3 |
| 15_1 | TCACattttactttaaccTC | 1.21 | 1.25 | 3 | 3 |

TABLE 9 -continued in vitro EC50 and Max efficacy of anti-ATXN2 compounds in U251 cells. ATXN2 mRNA levels are normalized to GUSB shown as % of control (PBS treated cells). The experiment was performed in duplex (sample A and B)

| CMP ID NO | Compound | EC50 [µM] A | EC50 [µM] B | mRNA level [% of ctrl] A | mRNA level [% of ctrl] B |
|---|---|---|---|---|---|
| 17_1 | TTCAcattttactttTAAC | 1.88 | 1.97 | 7 | 8 |
| 18_1 | TTCAcattttactttaACC | 1.45 | 1.74 | 4 | 3 |

TABLE 10 in vitro EC50 and Max efficacy of anti-ATXN2 compounds in US-02 cells. ATXN2 mRNA levels are normalized to GAPDH shown as % of control (PBS treated cells).

| CMP ID NO | Compound | EC50 [µM] | mRNA level [% of ctrl] |
|---|---|---|---|
| 7_1 | ATTTtactttaaccTCC | 0.17 | 2 |
| 13_1 | TCACattttactttaacCT | 0.20 | 2 |
| 14_1 | TCACattttactttAACC | 0.08 | 2 |
| 15_1 | TCACattttactttaaccTC | 0.12 | 1 |
| 17_1 | TTCAcattttactttTAAC | 0.24 | 2 |
| 18_1 | TTCAcattttactttaACC | 0.15 | 1 |

Example 3: Comparison of Compounds Targeting "Region 12" Vs Compounds Targeting Across the Human AXTN2

Over 1500 LNA gapmer oligonucleotides were designed across the ATXN2 pre-mRNA sequence (SEQ ID NO1) and their in vitro potency at the low dose of 0.5 µM was evaluated in A431 and U2OS cells. The results are summarized in FIG. 2. The data confirms that the hotspot region (SEQ ID NO 6) represented as solid circles provide highly potent compounds. FIG. 3 shows the selected hotspot region compounds alone.

Example 4 Testing In Vitro Efficacy of LNA Oligonucleotides in U2OS and A431 Cell Lines at 0.5 µM An oligonucleotide screen was done in three human cell lines using the LNA oligonucleotides in table 11, also targeting the region from position 83121 to 83144 of SEQ ID NO: 1. As described in the Examples above. The relative ATXN2 mRNA expression levels are shown in Table 11 as % of control (PBS-treated cells) i.e. the lower the value the larger the inhibition.

TABLE 11

| SEQ ID NO | CMP ID No | Compound | U2OS mRNA level | A431 mRNA level |
|---|---|---|---|---|
| 7 | 7_1 | ATTTtactttaaccTCC | 26 | 21 |
| 15 | 15_2 | TCaCAttttacttaaccCTC | 13 | 14 |

TABLE 11-continued

| SEQ ID NO | CMP ID No | Compound | U2OS mRNA level | A431 mRNA level |
|---|---|---|---|---|
| 15 | 15_3 | TCAcAttttactttaAcCTC | 13 | 13 |
| 15 | 15_4 | TCAcAttttactttaacCTC | 9 | 11 |
| 15 | 15_5 | TCACattttactttaAcCTC | 16 | 15 |
| 14 | 14_2 | TCAcAttttactttTaACC | 12 | 14 |
| 14 | 14_3 | TCACatttactttTaACC | 16 | 12 |

For the compounds, capital letters represent beta-D-oxy LNA nucleosides, lowercase letters represent DNA nucleosides, all LNA C are 5-methyl cytosine, all internucleoside linkages are phosphorothioate internucleoside linkages.

Example 5: Testing In Vitro EC50 and Efficacy of Selected Compounds

The EC50 of the compounds tested in example 3 were determined using the methodology as described in example 2, using a 10 mM as a starting concentration. The EC50 values were calculated as follows:

TABLE 12

| SEQ ID NO | CMP ID NO | U2OS EC50 (μM) | U2OS mRNA level at max KD | A431 EC50 (μM) | A431 mRNA level at max KD |
|---|---|---|---|---|---|
| 7 | 7_1 | 0.16 | 4 | 0.083 | 5 |
| 15 | 15_2 | 0.092 | 2 | 0.041 | 3 |
| 15 | 15_3 | 0.067 | 4 | 0.031 | 8 |
| 15 | 15_4 | 0.085 | 2 | 0.041 | 3 |
| 15 | 15_5 | 0.079 | 5 | 0.034 | 8 |
| 14 | 14_2 | 0.079 | 3 | 0.035 | 6 |
| 14 | 14_3 | 0.088 | 3 | 0.027 | 6 |

Example 6: Evaluation of Selected Compounds 7_1 and 15_4 Compared to Prior Art Compound ASO7 (Compound 37_1) in Mouse Primary Cortical Neuron Cell Compound 37_1=gtgggatacaaattctaggc, wherein bold underline letters represent 2'-O-MOE nucleosides, and the non-bold letters are DNA nucleosides, and all internucleoside linkages are phosphorothioate (as disclosed in Scholes et al., Nature volume 544, pages 362-366 (20 Apr. 2017).

Preparation of Mouse Primary Cortical Neuron Cell Cultures

Primary cortical neuron cultures were prepared from mouse embryo brains of 15 days of age according to standard procedure. In brief, culture plates were coated with Poly-L-Lysine (50 μg/ml Poly-L-Lysine, 10 mM Na-tetraborate, pH 8 buffer) for 2-3 hrs in a humidified incubator at 37° C. with 5% CO2. The plates were washed with 1×PBS before use. Harvested mouse embryo brains were dissected and homogenized by a razor blade and submerged into 38 ml dissection medium (HBSS, 0.01 M Hepes, Penicillin/Streptomycin). 2 ml trypsin was added and cells were incubated for 30 min at 37° C. After the incubation, 4 ml of trypsin stopper added and the cells were centrifuged down.

The cells were dispersed in 20 ml DMEM (+10% FBS) and passed through a syringe with a 13 g needle for further homogenization. This was followed by centrifugation at 500 rpm for 15 minutes. The supernatant was removed and cells were dispersed in DMEM (+10% FBS) and seeded in 96 well plates (0.1×10^6 cells/well in 100 μl). The neuronal cell cultures were ready for use directly after seeding.

Screening Oligonucleotides in Mouse Primary Cortical Neuron Cell Cultures

The following day, media was changed to growth medium (Gibco Neurobasal medium, B27 supplement, Glutamax, Penicillin-streptomycin) and 5 μM FdU in 96-well plates and incubated with oligonucleotides for 6 days at the desired concentrations. Total RNA was isolated from the cells and the knock-down efficacy was measured by qPCR analysis. For one-step qPCR (cDNA synthesis and qPCR), each sample was run in duplicates with one ATXN2 probeset (IDT, Leuven, Belgium) (ATXN2_assay1, Mm.PT.58.7178341) run in duplex either RPL4, Mm.PT.58.17609218, or RPS29, Mm.PT.58.21577577). To each reaction 4 μL of previously diluted RNA, 0.5 μL of water and 5.5 μL of TaqMan MasterMix was added. Plates were centrifuged and heat-chocked at 90° C. for 40 sek followed by a short incubation on ice before analyzing the samples using qPCR (Incubation at 50° C. for 15 minutes and 90° C. for 3 minutes followed by 40 cycles at 95° C. for 5 sec and 60° C. for 45 sec).

Data was analyzed using the relative standard curve method where each sample is first normalized to the geometric mean of the two housekeeping genes (RPL4 and RPS29) and then expressed as percent of untreated control animals.

Compounds used: 7_1, 15_4 & 37_1 (ASO7)

The results are shown in FIG. 4.

Example 7: In Vivo ICV Mouse Study

Animal Care

In vivo activity and tolerability of the compounds were tested in C57BL/6JBomTac female mice (16-23 g, Taconic Biosciences, Ejby, Denmark) housed 5-6 per cage. Animals were held in colony rooms maintained at constant temperature (22±2° C.) and humidity (55±10%) and illuminated for 12 hours per day (lights on at 0600 hours). All animals had ad libitum access to food and water throughout the studies. All mouse protocols were approved by the Danish National Committee for Ethics in Animal Experiments.

Administration Route—Intra-Cerebroventricular Injections.

The compounds were administered to mice by intracerebroventricular (ICV) injections. Prior to the ICV dosing, the mice were weighed and anaesthetized with isofluran or Propofol (30 mg/kg). Intracerebroventricular injections were performed using a Hamilton micro syringe with a FEP catheter fitted with a 23 gauge needle fixed in a stand adjusted to penetrate the correct distance (3.9 mm) through the skin and skull and into the right lateral ventricle. The mouse to be injected was held at the scruff of the neck with the thumb and first fingers of one hand. Applying gentle but firm pressure, the head was pressed upwards so that the needle pierced the skull 1-2 mm right of the midline (medio lateral) and 1-2 mm behind the eye. The bolus of test compound or vehicle was injected over 30 seconds with a previously determined infusion rate. To avoid reflux the mouse was held in this position for another 5 seconds before carefully being pulled downwards, away from the needle. This procedure required no surgery or incision. Animals were placed under a heating lamp until they recovered from the procedure. Brain tissue (cortex and cerebellum) as well as liver and kidney cortex was collected on dry ice for drug concentration analysis and ATXN2 mRNA and protein analysis at 2 or 4 weeks following dosing.

3 independent experiments were performed with groups of different compounds as shown in the table below (table 13).

Compound 36_1=TCCattaactactTTT, wherein capital letters represent beta-D-oxy LNA nucleosides, lowercase letters represent DNA nucleosides, all LNA C are 5-methyl cytosine, all internucleoside linkages are phosphorothioate internucleoside linkages.

TABLE 13

| Study no | Compound ID | Dose, μg | Time-point | Group Size |
|---|---|---|---|---|
| 1 | Saline only | 0 | 2 wk | 5 |
|  | 7_1 | 50 | 2 wk | 10 |
|  | 14_1 | 50 | 2 wk | 10 |
|  | 15_1 | 50 | 2 wk | 10 |
|  | Saline only | 0 | 2 wk | 5 |
|  | 7_1 | 100 | 2 wk | 10 |
|  | 14_1 | 100 | 2 wk | 10 |
|  | 15_1 | 100 | 2 wk | 10 |
|  | Saline only | 0 | 4 wk | 5 |
|  | 7_1 | 100 | 4 wk | 10 |
|  | 14_1 | 100 | 4 wk | 10 |
|  | 15_1 | 100 | 4 wk | 10 |

TABLE 13-continued

| Study no | Compound ID | Dose, µg | Time-point | Group Size |
|---|---|---|---|---|
| 2 | Saline only | 0 | 4 wk | 5 |
|  | 36_1 | 250 | 4 wk | 10 |
|  | 17_1 | 250 | 4 wk | 10 |
|  | 18_1 | 250 | 4 wk | 10 |
|  | ASO7 | 200 | 4 wk | 10 |
| 3 | Saline only | 0 | 2 wk | 6 |
|  | 15_3 | 250 | 2 wk | 6 |
|  | 15_4 | 250 | 2 wk | 6 |
|  | 14_3 | 250 | 2 wk | 6 |
|  | 14_2 | 250 | 2 wk | 6 |
|  | 15_2 | 250 | 2 wk | 6 |
|  | 15_5 | 250 | 2 wk | 6 |

Tolerability Results:

Acute toxicity was measured by monitoring the animal's behavior as described in WO2016/126995 (see example 9). Chronic toxicity was measured by monitoring the body weight of each animal during the time course of the experiment, with >5% weight reduction indicative of chronic toxicity. Note animals which exhibited signs of toxicity were euthanized, in some cases resulting early termination of the experiment (where a high proportion of the animals were exhibiting signs of toxicity all animals were euthanized).

Experiment 1

Compound 7_1: None of the animals showed signs of acute toxicity. 1 mouse showed weight loss over the course of the experiment (27 days).

Compound 14_1: 2 out of 10 animals exhibited acute toxicity, requiring euthanasia 1 day after administration. 5 of the remaining 8 animals showed weight loss over the course of the experiment (terminated on day 8).

Compound 15_1: 1 out of 10 animals exhibited acute toxicity, requiring euthanasia 1 day after administration. All of the remaining 8 animals, 5 showed weight loss over the course of the experiment (terminated on day 8).

Experiment 2

Compound 37_1 (ASO7) was acutely toxic to all 10 animals, with severe convulsions within 30 minutes after administration, requiring euthanasia 1 hour after administration.

Compound 36_1: 3 out of 10 animals exhibited acute toxicity, requiring euthanasia after 1 day after administration. 4 out of the remaining 7 animals showed weight loss over the course of the experiment (terminated on day 12).

Compound 17_1: None of the animals showed signs of acute toxicity. 2 out of the 10 animals showed weight loss over the time course of the experiment (29 days).

Compound 18_1: 1 out of 10 of the animals showed acute toxicity and were euthanized. 3 out of the remaining 9 animals showed weight loss over the time course of the experiment (29 days).

Experiment 3

Compound 15_3: 2 out of 6 animals exhibited acute toxicity, requiring euthanasia after 1 day after administration. Out of the remaining 4 animals, 2 showed reduced body weight over the time course of the experiment (terminated on day 15).

Compound 15_4: 2 out of 6 animals exhibited acute toxicity, requiring euthanasia after 1 day after administration. None of the remaining 4 animals exhibited weight loss over the course of the experiment (day 14 completion)

Compound 14_3: 1 out of six animals exhibited acute toxicity, requiring euthanasia 1 day after administration. Out of the remaining 5 animals, 3 showed reduced body weight over the time course of the experiment (terminated on day 9).

Compound 14_2: 2 out of 6 animals exhibited acute toxicity, requiring euthanasia 1 day after administration. Out of the remaining 4 animals, 3 showed reduced body weight over the time course of the experiment (terminated on day 15).

Compound 15_2: 2 out of 6 animals exhibited acute toxicity, requiring euthanasia 1 day after administration. Out of the remaining 4 animals, 3 showed reduced body weight over the time course of the experiment (terminated on day 10).

Compound 15_5: All six animals exhibited acute toxicity, requiring euthanasia 1 day after administration.

Tissue Homogenization for Oligo Content and ATXN2 mRNA Analysis

Mouse brain, liver and kidney samples were homogenized in the MagNA Pure LC RNA Isolation Tissue Lysis Buffer (Roche, Indianapolis, Ind.) using a Qiagen TissueLyzer II. The homogenates were incubated for 30 minutes at room temperature for complete lysis. After lysis the homogenates were centrifuged for 3 minutes at 13000 rpm and the supernatant used for analysis. Half was set aside for bioanalysis and for the other half, RNA extraction was continued directly.

Oligo Content Analysis

For bioanalysis, the samples were diluted 10-50 fold for oligo content measurements with a hybridization ELISA method. A biotinylated LNA-capture probe and a digoxigenin-conjugated LNA-detection probe (both 35 nM in 5×SSCT, each complementary to one end of the LNA oligonucleotide to be detected) was mixed with the diluted homogenates or relevant standards, incubated for 30 minutes at RT and then added to a streptavidine-coated ELISA plates (Nunc cat. no. 436014).

The plates were incubated for 1 hour at RT, washed in 2×SSCT (300 mM sodium chloride, 30 mM sodium citrate and 0.05% v/v Tween-20, pH 7.0) The captured LNA duplexes were detected using an anti-DIG antibodies conjugated with alkaline phosphatase (Roche Applied Science cat. No. 11093274910) and an alkaline phosphatase substrate system (Blue Phos substrate, KPL product code 50-88-00). The amount of oligo complexes was measured as absorbance at 615 nm on a Biotek reader.

Data was normalized to the tissue weight and expressed as nM of oligo.

ATXN2 mRNA Reduction

RNA was purified from 350 µL of supernatant using the MagNA Pure 96 instrument using the kit Cellular RNA Large Volume Kit (Roche, Indianapolis, Ind.). RNA samples were normalized to 2 ng/µL in RNase-Free water and stored at −20° C. until further use.

For one-step qPCR (cDNA synthesis and qPCR), each sample was run in duplicates with four probe sets (IDT, Leuven, Belgium) run in duplex (ATXN2_assay1, Mm.PT.58.7178341 in duplex with RPL4, Mm.PT.58.17609218, and ATXN2_assay2, Mm.PT.58.11673123 in duplex with RPS29, Mm.PT.58.21577577). To each reaction 4 µL of previously diluted RNA, 0.5 µL of water and 5.5 µL of TaqMan MasterMix was added. Plates were centrifuged and heat-chocked at 90° C. for 40 sek followed by a short incubation on ice before analyzing the samples using qPCR (Incubation at 50° C. for 15 minutes and 90° C. for 3 minutes followed by 40 cycles at 95° C. for 5 sec and 60° C. for 45 sec).

Data was analyzed using the relative standard curve method where each sample (the geometric mean of the two ATXN2 assays) is first normalized to the geometric mean of the two housekeeping genes (RPL4 and RPS29) and then expressed as percent of untreated control animals.

Tissue Homogenization for ATXN2 Protein Analysis

Mouse brain samples were homogenized in RIPA buffer with 1% Halt™ Protease and Phosphatase Inhibitor (Thermo Fisher Scientific) using a Qiagen TissueLyzer II. The homogenates were incubated for 30 minutes at 4° C. for complete lysis. After lysis the homogenates were centrifuged for 10 minutes at 14000 rcf and the supernatant aliquoted in smaller volumes, and stored at −20° C. until further use.

ATXN2 Protein Reduction

Samples were normalized to 0.05 mg/ml, based on total protein measured using the BCA Kit (Thermo Fisher Scientific). ATXN2 protein reduction was measured in duplex (Primary antibodies: Mouse Anti-Ataxin-2, 1:50, #611378, BD Bioscience and Anti-HPRT, 1:100, #ab109021, Abcam, Secondary antibodies: anti-mouse and anti-rabbit secondary antibodies, Protein Simple, San Jose, Calif.) and analyzed on the capillary Western immune assay WES instrument (Protein Simple) according to the manufacturers standard protocol.

Data was analyzed in relative quantities where the ATXN2 expression for each sample is first normalized to the housekeeping protein (HPRT) and then expressed as percent of untreated control animals.

The results are shown in FIGS. 5-7.

FIG. 5: Comparison of the knock-down (mRNA) of 11 selected compounds, compiled data from the three experiments, study 1=filled dots, study 2=empty dots, study 3 half-filled dots.

FIG. 6: Knock-down at protein and mRNA level and exposure in cortex, cerebellum regions for compound 7_1. Protein data for cortex only is shown.

FIG. 7: Knock-down at protein and mRNA level and exposure in cortex, cerebellum regions for compound 15_4. Protein data for cortex only is shown.

Example 8: In Vivo ICV Mouse Study—Duration of Action

A new study was set up to investigate the duration of action of compound 7_1. 15_4 was included for one-time point only (7 days). The procedure is as described in example 7 using the following protocol:

TABLE 14

| Study no | Compound ID | Dose, µg | Time-point | Group Size |
|---|---|---|---|---|
| 4 | Saline only | 0 | 1 wk | 6 |
| 4 | Saline only | 0 | 8 wk | 6 |
| 4 | 7_1 | 150 | 24 h | 6 |
| 4 | 7_1 | 150 | 1 wk | 6 |
| 4 | 7_1 | 150 | 4 wk | 6 |
| 4 | 7_1 | 150 | 6 wk | 6 |
| 4 | 7_1 | 150 | 8 wk | 6 |
| 4 | 15_4 | 150 | 1 wk | 6 |

The mRNA knockdown results are shown in FIG. 8, which illustrates robust and potent knock-down on ATXN2 mRNA in both cortex and in particular cerebellum tissues for at least 56 days (the maximum level of efficacy is maintained from 7-56 days, indicating that the effective duration of action is considerably longer than 56 days. There appears to be some mice where treatment was not as effective, and as this is associated with the same individual mice across the time course is likely to be procedure related.

Example 9: In Vivo Cynomolgus Monkey Study

Subjects

Subjects were male and female cynomolgus monkeys weighing 2-4 kg at the initiation of dosing. Each was implanted with a polyurethane catheter in the lumbar intrathecal space. The proximal end of the catheter was connected to a subcutaneous access port to allow for injection into the intrathecal space and withdrawal of CSF samples.

Cynomolgus monkeys were administered with either a saline, compound ID 7_1 or compound ID 15_4, which was dissolved in saline at 0.33 ml/min in a 1.0 ml volume followed by a 1.5 ml of aCSF. Total infusion time was 4.5 min. See table 15 for information on doses, duration, group size and tissues.

TABLE 15

| Compound ID | Dose, mg | Time-point | Group Size |
|---|---|---|---|
| Saline only | 0 | 2 wk | 2 |
| 7_1 | 4 | 2 wk | 3 |
| 7_1 | 8 | 2 wk | 3 |
| 7_1 | 24 | 2 wk | 3 |
| 15_4 | 8 | 2 wk | 3 |

CSF was collected from the lumbar access port the port by gravity flow to a maximum of 0.8 ml CSF per sample. The CSF was centrifuged and the supernatant was kept at −80° C. until analyzed. Blood plasma obtained from an available vein was kept at −80° C. until analyzed.

Cynomolgus monkeys were administered the appropriate volume of a commercially available euthanasia solution while anesthetized with ketamine and isoflurane. Necropsy tissues were obtained immediately thereafter and the brain was transferred to a chilled surface for dissection. All samples were collected using clean removal techniques, weighed and frozen for dry ice for drug concentration analysis and ATXN2 mRNA analysis.

Tolerability

During the in life phase, no adverse clinical effects were reported. Histopathology showed no concern for either compound at the levels tested.

Tissue homogenization for oligo content and ATXN2 mRNA analysis

See example 7—the same procedure was used.

Oligo Content Analysis

For bioanalysis, the samples were diluted 50-100 fold for oligo content measurements with a hybridization ELISA method. A biotinylated LNA-capture probe and a digoxigenin-conjugated LNA-detection probe (both 35 nM in 5×SSCT, each complementary to one end of the LNA oligonucleotide to be detected) was mixed with the diluted homogenates or relevant standards, incubated for 30 minutes at RT and then added to a streptavidine-coated ELISA plates (Nunc cat. no. 436014).

The plates were incubated for 1 hour at RT, washed in 2×SSCT (300 mM sodium chloride, 30 mM sodium citrate and 0.05% v/v Tween-20, pH 7.0) The captured LNA duplexes were detected using an anti-DIG antibodies conjugated with alkaline phosphatase (Roche Applied Science cat. No. 11093274910) and an alkaline phosphatase substrate system (Blue Phos substrate, KPL product code 50-88-00). The amount of oligo complexes was measured as absorbance at 615 nm on a Biotek reader.

Data was normalized to the tissue weight and expressed as nM of oligo.

ATXN2 mRNA Reduction

RNA was purified from 350 µL of supernatant using the MagNA Pure 96 instrument using the kit Cellular RNA Large Volume Kit (Roche, Indianapolis, Ind.). RNA samples were normalized to 2 ng/µL in RNase-Free water and stored at −20° C. until further use.

For one-step qPCR (cDNA synthesis and qPCR), each sample was run in duplicates with four probe sets (IDT, Leuven, Belgium) for ATXN2 (see table 16) and four probe sets for different housekeeping genes (GAPDH, Mf04392546_g1, POLR3F, Mf02860939_m1, YWHAZ, Mf02920410_m1 and UBC, Mf02798368_m1) (Thermo Fisher Scientific) run in singleplex.

TABLE 16

Primer and Probe sequences for Mf (macaca fascicularis) ATXN2 assays.

| Assay name | Primer 1 (5'-3') | Primer 2 (5'-3') | Probe (5'-3') |
|---|---|---|---|
| Mf_ATXN2_assay 1 | CCAGCTTACTCCACGCAATA (SEQ ID NO 38) | CATGAGGATGCTGAGACTGATAA (SEQ ID NO 39) | 56-FAM/TCCTCAGCA/ZEN/GTTCCCAAATCAGCC/3IABkFQ (SEQ ID NO 40) |
| Mf_ATXN2_assay 2 | AGCTGTTGCCATGCCTATT (SEQ ID NO 41) | GGAGAGTTCTGCCTTTGATCTT (SEQ ID NO 42) | 56-FAM/TGCTAGTCC/ZEN/TGCATCGAACAGAGC/3IABkFQ (SEQ ID NO 43) |
| Mf_ATXN2_assay 3 | TTCAACCCACGTTCCTTCTC (SEQ ID NO 44) | GCTGTTGATGACCCACCATA (SEQ ID NO 45) | 56-FAM/AACTTCACC/ZEN/TCGGCCTCAAGCA/3IABkFQ (SEQ ID NO 46) |
| Mf_ATXN2_assay 4 | CTCCAGCTCCTGTCTCTACTAT (SEQ ID NO 47) | ACTCTGIGATTTCGAGGATGTC (SEQ ID NO 48) | 56-FAM/TTCAGAAGG/ZEN/GCCTCCAAGGATGTC/3IABkFQ (SEQ ID NO 49) |

To each reaction 4 µL of previously diluted RNA, 0.5 µL of water and 5.5 µL of TaqMan MasterMix was added. Plates were centrifuged and heat-chocked at 90° C. for 40 sek followed by a short incubation on ice before analyzing the samples using qPCR (Incubation at 50° C. for 15 minutes and 90° C. for 3 minutes followed by 40 cycles at 95° C. for 5 sec and 60° C. for 45 sec).

Data was analyzed using the relative standard curve method where each sample (an average of the four ATXN2 assays) is first normalized to an average of the three best performing housekeeping genes of each tissue—determined by a geNORM analysis described in Vandesompele et al, 2002, Genome Biology 2002, 3(7):research 0034.1-0034.11—and then expressed as percent of untreated control animals (see FIG. 9).

Tissue Homogenization for ATXN2 Protein Analysis

Same as mouse studies

ATXN2 Protein Reduction

Cerebellum and cortex samples were normalized to 0.2 mg/ml, based on total protein measured using the BCA Kit (Thermo Fisher Scientific). ATXN2 protein reduction was measured in duplex (Primary antibodies: Mouse Anti-Ataxin-2, 1:50, #611378, BD Bioscience and Anti-HPRT, 1:50, #ab109021, Abcam, Secondary antibodies: anti-mouse and anti-rabbit secondary antibodies, Protein Simple, San Jose, Calif.) and analyzed on the capillary Western immune assay WES instrument (Protein Simple) according to the manufacturers standard protocol.

Data was analyzed in relative quantities where the ATXN2 expression for each sample is first normalized to the housekeeping protein (HPRT) and then expressed as percent of untreated control animals.

The results are shown in FIGS. 9 and 10.

SEQUENCE LISTING (49 sequences)

SEQ ID NO: 1 - DNA, 147463 bp, homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcaggtgggtgtcggcaccccagccccctccgctccgggcccggcgtcccctcccccgcggcccgcgccgccgtccccgccccgtgacccgccgggctacccggggtgggctgggggccggcagcgcgggggagactcgctcgggcctgagccccgaggctcggccggtgggcgcagccggggtcctctgggattgtcaggcctgtccagcctcccgcagcatccccgccccctcccccggcggtcaagatggagggagcgggcggcctcccctccccacgcgtgttgggaggggttctcgggtagcggcgatggtcagccccggctcccccttccgcacgatcctccgcccgcagcgtggggatgctcgggcagctcctccactcccggtttaggtgtgaacgttggaggggtctggaggctgtggtggcgttttccggaacatgtccccctccatgggggacatctctggaggggagaagttagggccgcgtcccccgtgccggttaaaggggtaggcaccgggctcctccggaatcatcagggtctgtcggggctctctccccgccccctccgagtcctgggaaagatcggaggacggggtggagacaagtgggccttggcccccgcacccctctgcgttcgtgtccgaggcggcggcgggggctcccgaactcccctgaaatcgtggggctccatgtggcctccggcagcgttccaccctcccccacctggggaagggaaggggtggggagtgcccggccccgtcccggccttcctccttcccccgccagacctctccggcgcgcgggtggtggccgatccgcattgctgttcgaggccgcagtggagaaggcgcctgtggaacatcggtgggtgagggctggacccaggctggaccctggagatccggggtggcggtgctggtggcagggggcgggcaccctgcgcacttatcccaacccccgccccaatttcggaaatgctaggagagagagattgcagcaggggacgtggtcgggttcctgaaggcagaaaggcgggtgtttactagcgtctttttccctcctaagccggggttgtagtaggggctgggggctcagtgttgtcccggctaactgggtttgactcgagggtgtgtttgtgcaggagggcctgttgggggtggcgggcggttgtcagttcgtatttcacgaactaagaaaatgcttagtgttcaaagggagaaggaaacgtcaatagactccattccattgtggccggtgtccttaacttcgggagtgccgccagagcttaccaagggcacgcaagtccatttcccttgtgcctcaagtccatccgtgttgtaggcactactgtgccttctttaggcctaggccgccggcttgacggcgggtgaccggcgtcctccttaaataggcatcttgggctttggaaggtggaataagaggatttttcattcacccgagttttctttttgaaaacacattttcagcaacccatttccaaagaatttttatttacagcagaaattccccatcaagaggaatcagctggtttttaaggaattctgctgccttcaaagggggcggaaacagtcggttatttgactttacacgccccgcccccccttccccttctctgagtctgaagcatcccaaacactacttagccaaactagttcagatgaagtgatcgtttccccaagtagggtaacttcagtttccctttttcgttggcatctagcgaaaaatgaaaaaatttaaaatacaacttttatagaaaaggatgtattctgtttttactttcttaggtattaggaagagatttggcagataattcaacatgttcaaatatataaacattaaaactaaggttattaagttgcattgactactaggcttaaaaattagattataagagaatttgctcctgagtagtttgagtgatcaaagatatttggaatgttttagtaccacaaggtcttttttctgttccttgaggctttacaacaatttaaggttaatttagatttttccttgctttaagttcttttacttgagacctaaatggcagcccttattctttctgatgaataggtgaaattttgtttactgtgttggatttgtgtaatgtgaagttttattcttgaacagatcgttaatgtacttgtagaattactttgaatttgaatcactttcctgcattccttgtaaataagtttcagcttctagaatctcctcacttaggtttgtgcgtatcaacagtgaaaataagtctctgagagcaagggtgaaaaaaaatgcagcattcggtttgacaagtttcgagatagcaaaatatgcttgaaagtctggaaattcacatctgctttaagaaacatttcataatttgactttgtgtgtgtgtgtgtgaatagtttttcatgactttcagaagtgatttattttgttctttgttatatatatttttgaaggtggctgttttaggaaagataatgtaatcacaatattagaacataattttactgtaatctaattttgtgtgtgtgtgtgtgtgtgtgtgtgtgtgtgtgtgtgtgttttggatggaatctcactctgtcgcccaggctggagtgcagtggcctgatctcagcttactgcagtctctgtctcctgggttcatttaagtgattctccagcctcagcctccccagtagctgggattacaggttcgtgctaccacacctggctaatttttttgtatttttagtgaggacgggattttgccatgttggccaggctggtctcgaactcctgacctcaagtgatccgcctgccttggcctcccaaagtgctgggattacaggcgtgagctactgcccctggccaatttttgtatttttagtagagatggggtttcaccatgttggccaggctggtctcgaactcctcctgacctcaagtgattcgccagcctcggcctcccaaagtgccaggattacaggcaggaatgagccactgcccccaaccatcagtctaattcttatttttgctttttaccttttcatttttatgtagtagaggtgattgtgtatgttattttgtagttagcttttttcccctgaacgttgtattgtaaatgtaaatttttttttttttttttgagacagagtctcggtgtttgcccagtctgaagtgcagtggtacgatctcagctcactgcagcctctgactcctgggttcaagcgattctcccacctcagcctcttgagtagctggggctacaggaatgttccaccacgcttggctaatttttgtatttttggtagagacaaggtttcaccatgttggccagtttggtctcgtactaccgacctcaggtgatgcgcccgcctcggcctcccaaagtgctgggattgcaggcgtgagccactgcgcccggctgtaaggtttttacttaaccattctattgttgggaattgggtttccacttttttgttatagatagtggtgcagtgaacatttttaaatagctttttgcttcagtgtaattatttccttagagaaagttaccaagagtggttttactagttcagagggcttcaggatttttatggctcttgctagcggtgctctattattctttagaagacttgtattacttccagtgtcaagaaggttgctcttccatggaatggtttctttgtagtttgtcaaatattgtggggaatttttaaaggaaaaattgcatttttactgtcaagtgcatatattattaagtgcttttgttagttactggattattgatatttgagtttaatttggttcctctgaggatttaataaggtaatatatgtgaagatgttttgaaacctgtaaccattattattaatgagggtacttggtttatctgtcgtgctgatagtactgagtaaagtgcaggaatgaaattcctgaggaactgttctaaagctttgttgttgttgttaacctttctttttcatctgaaagtgttttttattagctgctagcctatgaccaagttatttttggtaacttttttgtaatttcatggcactattgggaattttcgctggttgactcttcttcttctacattcccttccccattaaaaataaaaatatggatttacaattgttactctattcctaaacctaaataatatgacattagaattgcttgggatacaggattcagtctgaataaaatatttttcttttagtgattttcagcttagtatttttactgcttctttctcttgaggcattgcaacttaaaaattgtgctgtttagccaggcgcctgtaatcccagctacttgggaggctgaggcaggagcatcacttgagcccaggaggcggaggttgcagtcagctgagattgtgccactgcactccagcctgggagacagagtgagactctatctcaaaaaaaaaaaaaatgtgctgtgatttaatgtagttgttcatcatgcttccatttaaatttcagtgagactgttcatcttttgcagttaaatatcttgtagaagggcctaaaatatctacgttgaatacagctttattgaagcatctatgtacatggggtttttgggatgaatcagtgaataaagcaaacatattgtccttttggagtttacattctaatgtgactaggcagacaatgagacattaaattaccagcctatgtataatagtgtataagagctatggaattagaagaaagcagattaaaggtatagggagtgtggggaggggaatgagttacaattttaaatggattgggggaacttaattgaggagctaacatttgagcaaagatttgaaggttgggtatttagccgtttgctttttatctaggttaattagtcatgtggcttcattagtaatttataaggtttaaatggcatcatcctttgttattcttttatgtgcacattgatactaaccatctctgaagttagaccaaaaaagttaattgacattgagggtcattagaggtaaattgtagatggctattactaaccaaagagacatgttttgtttttcttttgggcttacgtattttacctaattagtttagtttttgtttcaagtatgtggagaaaataaactttttaagtttgggccaaaacttgctttggttttctttttctttttctttttttttttttaagagaaaaatgtaagcctgtagttgcttaaagattccacattctgaaacagtgaaaacatgggatcagtcatggtgttcctttttttggttaaatgtaaacttgtattttcagtgttactctaattagcaatggtttatacttctacataagggatgttaactcatattgtagctatttaatagccatatattttgacttaaaggaggatctcaaggccaggcgcggtggctcatacctgtaatcccagcactttaggaggctgaggcgggtggatcacctggggtcaggagtttgagactagtctggccaacatggtgaaacccccatctctactaaaaatacaaaaattagccgggcatggtggtgggcgcctgtaatcccagcttcttgggaggctgagggaagagaattgcttgatcccggaggttgcaatgagtgcggaggttgcagtgagctgagatcatgccattacactccagcctgggcaacagagcgagactctgtctcaaaacaaacaaacaaacaaaaaaaggaggatctcatttttttgtcctaaatagctacagccgtgttagaactgtcaccttagcaaagtattgtttttttactttgaaacgaattttaaggttttagaagattgttctctagaattacaattttctgttttgactagtgatagtattttgatgttgtgtaaatagttgagcatgaacaaaaccctatttttttttttagctatttcaagtgattgtgacaacttcaacggagatgtaaacagtttattaacagtcacacctattatcttttttttttttttttttttttgagacggagtcttgctctgtcgcccaggctggagtgcagtggcacgatctctgcttactgcaacctttgcctcccgggttcaagtgattctcctgcctcagcctcctgagtagctgggtctacatgcgcacaccaccacgcctggctaatttttgtatttttagtagagacagggtttcaccatgttggctagaatggtctcaaactcctgacctcaggtgatccacctgcctcagcctcccaaagttctgggattacaggcatgagccaccgtgcttggccgctgccgtatctttttaaatgaaagtacttgtgttttttttgtttttttccaaaggatatctgggtcatctatgatgttactgttaccatctaagggtttttttgtttgtttttgagacagagtctctgtcgcccaggctggagtgcagtggcgtgatcttggctcactgcaacctccgcctcccaggttcaagcaattctcctgccttagccctcccgaatagctgggattacaggcacccgccaccatgcctggctaagttttgcatttttagtagatatggagtttcaccatgttggccaggctgctcttgaactcctgacctcaggtgattcgcttgcctcggcctcccaaagtgctgggattacaggcgtgagccacccccgcccagcctcatgagctaaggtgttttttttttttttgagacagttttgctctttcccaggctggagtgcagtggtgcaatctcagctcactgcaacctctgtttcccgggttcaagcgattctcctgcctcagccttctgagtagctgagattacaggtgcctgctaccccactcagctaatttttgtatttttagcagagacagggtttcaccatgttggttaggctcatctcgaactcctgaccttaagcgatccacctgccttggcctcccaaagtgctgggattataggcatgagccaccgtgcgcagcctaccctgtctcttaaaaaacagtaacaacaacaacaacaacaaaaaatcctaaatcttaaaaatggaaggcaaaaactctaagctttgagagattaggggacttgcccaaagcaatatttgtaggattttattacacctctccctttatttatttttttagagtcaaggtctccctctgtcacccaggctggagtgcagcctcaatctatggggccaagcatttctcctgtcttagcctcctgagtagctggaactacaggtgtacaccagctggctaacatttaaattttttgtagagacagggtcctgccatgttgcccagattggtctcaaactcctgggctcaagtgatcctcctgcctcagcttcccaaagtgctgagattacaggtgtgagccactgcaccgagccccctccctttatttttatttttaaattttaagttctggggcccctcccttgaaataaatagaaacgtaatatatacacaagatcatgctgtgtattttaaggcaatggtcctcaacctttttaacactagggaccggttttgtggaagatggtttttccataggggcaggggatgattttgagatgaaactgttccaccggccgggcacggtggctcacgcctgtaatcccagcactttgggaggccgaggcgggcagatcacgaggtcaggagatcgagaccatcctggctaacatggtgaaacccccctctactaaaaatacaaaaaaattagctgggcgcggtggagggcgcctgtagtcacagctactccggaggccgaggcaagagaatggcatgaaacccgggaggcagagcttgcagtgagctgagatagcaccactgtacttcagcctgggggacaaagtgagactccgtctaaaaaaaaaaaaattgttccacctcagatcattatgcatttgttagattctcataaagagcatacaacctacatctcttgctatatgcagttcccagtagggtttgtgcttctataagaacctaatgctgcacctgatctaacaggtggggctcaggtgctaatgctcacacagctcctgttgtgcagtctggttcctaacaggcctgtttttttttttttaattagatggagtctcgctctgtcaccaggctggagtgcagtggcacgatctcagctcactgcaacctctgcctcccgggttcaagcgattctcctgccttagcctcccatgtagttggtactacaggcgcacactgtgatgcccagctaatttttgtatttttagtagagacggggtttcaccatgttggccaggatggtgtcgatctcctgaccttgtgatccgcccaacagcctcccaaagtgctggaattacaggcgtgagctgctgcgtccggccccctaacaggcttgttttatggaatacagtcacggacagtacttgcccttcaggatatctttttgtaaccttgattttggcttgctaaaataggaggtctattttcttttctttgtttttaatgtatgtggttctgtacttacgtggtgtgaaatctacataaatgttaaatccttggttatttatttattttgagacagagtctcactctgtcacccagtctggaaagcagtggcataatctcggctcactgtaacctccacttcccaggttccagtgattctcctgcctcagcctcctgagtagctgggattacaggcatgcaccactacacctggcaaatttttgtatttttttttagtagagatggggtttcaccatgttggccaggctcgtcttgaactcctgaccttaggtgatctgcctgtcttggcctcccaaagttttgggattacagcatgagccactgcgcctcgccttatttttttgagacaggttctagctctgtcacccaggcgggagtgcagtggtgccatcatggctcattgcaacctcgagttctcaggcccaagtgatcctcctatctcagcctcctgagtagctgggaccacaggcatgcgccactatgcccagcaaaatttttgtttcactctgttgcctagggtggggtgcagtggcaggatatcggctcagtgcaacctctgcctcttgcgttcaaatgattctcatgcctcagcctcccgagtagctgggattataggcatgcgccactacacctggctaatttttgtattattggtagagatggggttttatcatgttggccaggctggtctcgaactcccgacctcaggtgatccatataccttggcctcctgaagtgctggaattacaggcataagccactgcgcctagcttttttgtttgtttttattttgtagggacagagattttacctgttgcccaggatggccttgaattcctgacctcaaacaatttgccctccttggcctcccaaggtgctgggattacaggtgtgagccactatgcctggctggttttttaaattattattattgtttgtgtgtgtgtgttgcaggatcttaccctgtcacccaggctggaatgcagtgatgtgatctcggcttactgcaacctccgcctcctaggttcaagtgattgtcctgcctcagcctcctgagtagctgggataacagctgtgtgccaccatgcctggctaatttttgtatttttagtagagatggggtttcatcatgttggccaggctggtctcgaactcctgaccttagatgatccacccgcctcgtcctcccaaagtgctgggattacaggtgtgagccaccgtgaccagtttggtttagtttttttttttttttttttttttttttttttttgagaaatctcgctctgtcgcccaggctagagtgcggtgacacaatctcagctcactgcaagctccacctcccaggttcatgccattctcctgcctcagcctcccgagtagctgggactacatgcgcccgccaccatgcccggctaattttttttatgcattttaagtagagatggggtttcactgtgttagccaggattgtctcaatctcccgacctcttgatctgcccgcctcggcttcccaaagtgctgggattataggcatgagccaccgcgtccggcctggtttggtattttttttatgagtctgggttgtttatgaaaacttgtcacagctgttaaccttaactttttttttttcttttttttccgagacggagtctcgctctgtcacctaggctggagtgcagtggtgcgatctcggctcattgcaacctctgcctcccaggttaaagcgatttttctgcctcagcctcctgagtagctgggactgcaggcacgcaccatctcgcctggctaatttttgtattttagtagagatggggtttcaccatattggccaggctggtctggaacttctggcctcaagtgatccacctgccttggcctcccatgcctggcaaccttaactttttatttgctggtaattatttgtgtttgcattcatgtgaaaatttgaaattctcattaacatttaaagattcttacatagattgcttgtaattttaaccctgaagttgtgtcaagtgactttacaatgtcaatttgttttatttatttatttatttatttatttatttatttttgtgataggatctggctctgttgctaaggctggagtgcagtgttgcaaatacggctcactgcaacctctgtctcccgggttcaagccatcctcccacctcagcctcccaagtagttggaactactggtgcgccccacagtgcctgcctagtttttttgtattttcagtagatgtggagttttgccatgttgatcttgaactcatggcctcgagtgatccaccccacttaggcctcctaacatgctggtgttacaggtgtgagccactgtgtccagcccgaaaatgtcagtttcgtgccatgattaatagctaactacattttgggaatgtaataaaatttcattctataatgaagtctttgtaaaactcattagttgtggtatgaggcttgtcggcaatataagtgaacgtggtttatttttattaactgtatcagaactttagaatgttggtctcctgaaaccattgccttgagaggctttattgaacagtgttgccaatgatcagtttttttttaaatttccttttttttgagactgagtcttaccctgttggccaggttggagtatagtggtatggtcatggctcactgcagcctcaacatcctgggctcaagcagtcctcctacctcagtctcccgagtagctggaactacaggtgtatgccaccatgcctggcttttgtatattttgtagagacagggtttagccatgttgcccaggctggtctcaaactcttaaattcaaatgatccacccacctagttttcccaaagtgctttaattacatgtgtgaggcaccgtggctggccaggtcaaatatttttcattgacgtttttcatattgctttttaaagtcatgttaaaatattcttaataatttttctaagtggaattaatcttgattataattttagttttttataaagggcgggttttgaaacaagtactgcatttttcttttcgggtttataaacatttgctgtggactttgtgcagttaactattttcattcctgaaacacatttcgaaatcaggaattgaagactaaatgtcttttcactgaagcttgagcagattttagaaaggggagttcttttttttttttttttttttggtagaaatgggggtcttgttatgttgcccaggctggcctccaacttctgggcttaaactgtcctcctgctttagcctctggtctggagagttctttatggcctctttgagaacttttactttacacatgattctatctagctttcttttctgatgtacatattggcagcaagtagaaaagcaatgttttcagaggcagatatattaacagcaatgagaaataacagtagcgtgatagaaagttgaaagacttagctgggtgcggtggctcacgcttgtaatcccagcactttgggaggccaaggagggtggatcacttgaggtcaggagttcgagaccagtctggccaacatggtgaaaccctgtctctactgaaaaacagaaaaagggccgggcgtggtggctcacccctgtaatcccagcactttgggaggttgaggagggcggattacaaggtcaagagattgagaccattctggccaacagggtgaaaccccatctctactaaaaatacaaaaaaattaaatgggcgtggtgatgtgtgcctgtagtcccagctactcgggaggctgaggcaggagaattgcttgaacccgggaggcagaggttgcagtgagccgagatcgggccactgcactgacgacagagggagactccgtctaaaaaaaaaaaaaaaaaaaaaaaaccagacttggggctgggcgggcgcctgtaatcccagctacttgggaggctgaggcaggagaatcgcttgaacccgggaggtgaaggttgcagtgagctcagattgtgccactgtgccccagcctgggccacagagcagagtgagactctgtctcaaaaaaaaaaaaaaagtttggaagactggtggctgggcatggtggctcacacctgtaatcccaacactttgggaggctgaagcaggcagattacctgagcccaggagttcaagtccagcctgggcaacacagggaaaccccatctcaacaaaaaatattaatacaaaaaatttagccagtcatggtcgtgcacttctgtagtctcagctacttgggaggctgaggcaggtggttcacttaagtctggatgtcgaggtgagccatgattgcaccactgcactccagcctgggcgttaaaatgagaccttatctcaaaaaaacaaagcaaagagcctgggaactactaaaatgggaactactaaaaaacagacacaagagctcaacaagtataccattctgggaggtttttttttttttttttttttttttttttgagatggagttttgctcttgtcacccaggctggagtgcaatggcgccatctctgctcactgtagttccgcctcccaggttcaagcagttctcctgcctgactcctgagtagctgggagtacagatattggtcacacaccgggttaatttttgtatttttagtagagacggggtttccccattttggccaggctggtctcgaactcctgacctcaggtgatccgcctgcttcagcctcccaaagtgccgggaccacaggcgtgagccaccgcacctggctttttttttttgacatagaatcttgttctgttgcccaggctggagtgcaatggtacaatcttggcccactgcaacctctgcctcccagcttctagcgattttcctgcctctgactcctgagtagctgggattacgggtgcccgccaccacacccggataatttttgtatttttagtagagatggggttttgccatattggccaggccggtcttgaactcctgacctcagatgatccacctgcctaggcctcccaaagtgccgggattacaggcgtgagccaccactcccggcctgggagttttgactgtaagtttatagctgtatatcttaggccctaagggcattactgttttatagcacagtgtagttagttaatgtgctcataatggtgactcataacaccaggttaaatgattttttatatctcccaaagaagtatttttcaatctgcagatcatgaccccttagtagattgtgaaacacattagtggattatgacaagcatttttagaaaaatgaaaaagaataagaagtgttaggatgcattgcattattgaaataattgtttttgagatggagtttcgctcttagttgccgaggctggagtgcaatggcccgatctgcctcccgggttcaagtgattctcctacctcagcctcctgagtagctgggattacagacatgctccaccatgcctggctaattttgtatttagttttagtagagatggggtttctccatgttggtcaggctggtcttgaactcctgacctcaggtgatccacttgcctcggcctcccaaagtgctggggatacaggcatgaacccctgtgcccggcctaatttttgtatttttagtagagatggggtttcaccatgttggccaggatagtcttgatctcttgacctcgtaatctgcccacctcgactcccaaagtgctgggattacaggtgtgagccactgcacccagctgccaagaattgttttaagctttggtttgagttaatgtatatataccgcattgtaattcaaaatgtaatttttggccaactctgggcacattgcctatggactagtcctgctctgccacgagcagcaacagttcaatgaattttttttttttttttttttttttttttttttttgagacagggtctctgtcaccaaggctagaatgtagtggtgcagtctcggctcactgcaacctctgtttcctgggctcaagcgatcctcccacctcagcctcctgagtagctgggagtacaggagcacgctaccatgcctggctaatttttgtattttttgaagagatgaggttttgccatgttgttcaggctagtcttgaactctggagctcagatgatccacccaccttggtgtccagaaatgctgggattacagggatgagccaccgtgcctagccaaaaatttttttttaagtaattttttattgatatagtcaaaaaagttactgctttagagccagagaaacgcagtaaaaggattgagaaagagttttgaggttatatctaagctagggttgtcagatttggcaaatagaaatacaggacactcagttaaatttgaatttttgatgaacattgaccagttttttagtataattgtgtattaaattgcatagaaaaaagttatttatctaaagttgaaatttaactgagcatcttgtattttatctggcaactccagtctaagctggaatcatggttcactgttttttttttttttttttttttttgagtcggagtcttgctgtgttgcccaggctggagtgcaatggtgcgatcttggctcactgcaacctccacctcctgtgttcaagtgattctcctgcctcagcctcctgaatagttgggattacaggcacccaccaccatgcccagctaatttttatatttttagtagagacggggttttcgccatgttgttcaggctggtcttgaactcctgacctcaggtggtccgcccacctgggcctcccaacgtgctgggattacaggcatgatctaccgtgcctggccatggttcactcttcagtaactaaaatttaagctctatgaaagcaggaactttgttttgttcactattgattgtatccctatttcttgaatggttggcacttaactgcttggtcacatgtttgaatgggcaagttactcagccactctcaggcttagtttatttacctattaaaagagaaagaatatcttccttggctgggcgcggtggctcacgcctataatcccagcactttgggaggctgaggcgggtggatcacgaggtcaggagatcgagaccaacctgggcaacattgtgaaacctcatctctactaaaatagaaaaaattagctgggcatggtggtgcgcatctgtagtcccagctactcgagaggctgaggcaggggaatcgcttgaacccaggaggtggaggttgcagtgagccaagattgtgccactgcactccagcctgggcgacagaacgagactctgtctccaaaaaaaaaaaaaaaacaaacaaaaaaaaaaactgagatactggccgggcgcggtggctcgtgcctgtaatcccagcactttggaaggccgaggcgggtggatcacgaggtcaggagatcgagaccgtcctgcctaacatggggaaaccctgtctctactaaaaatacaaaaaattagccaggcgtggtggcgggcgcctgtaatcccagctacttgggaggctgaggcaggagaatggcgtgaacccgggaggcagagcttgcagtgagcggagatggtgccactgcactccagcctgctgggcgacagagcgagactccgtctcaaacaaacaaacaaacaaacaaaaaaactgagatactaaagtcttaatattttctgtttttatgtatttattttttgagatgggatcttgctgtattgcccaggttggagtacagtattgtgatcatggcttattgcagcctttaactcctgggttcaagtgatcctcccacctcagcctcctgagtagctgggaccacaggcacatgcaacatcacaccctgcagttctttttttttttttgagacaccgtctcgctttgtcacccaggctgcagtgcgtggtgcaatttctgctcactctaacctccacctcccgagttcaagcagttctgcctcagcctcctgagtagcttgggaccacatgtgtgtgccatcatgcctggttaattttttgtatttttagtagtgacagggtcttaccatgttgcccaggttggtctcaaactcctgagctcaagtgatctgcccgccttcgcctcccaaagtgtctgcgccctacaatttaaaaaaatttttgtagagacagtctcactgttacccgggctggttttgaacttctgccctcaagtactcctcttgccttggcctcccaaagtattgaaattaaggccatgaggcagcacacccagcctaaattcttcttatgttctgttcttggcacatagtagatgttcaacaatgtagagtcaaacgcatttggagttggaatggctctggtgttttttttttttttttaaaccagaaacacgtgcagtttattgaatgccattgtagaaaagtgtgtgaggataaacggctgatagagaacttggctctgggggcagggcgaggaatggagggtggatggagtacatgggaatcagatcacgggcagagctcctggcctagataatgcctcctgatctgttgatagacttgaaagatcaacactgggatgatgctgagcagaatggtcgtaatgatgcgcacaatcagggcccagatgttcaggcacttggcggtaaaggcataggcctgggccctgatcaggtcgccaaccatcttcttgtccctagacttcacggagtaggccaatgctatgaagcccaggcagcaggagttcatgaagtgggtgttgaacagggaccagacgacatggtcgggcacggagttctcgctgtggatggggatcacggtggacattgggggagcagggttgtggggtgcccccagcacagccacctcttgctcctccttgagcatctcatagttagggggatggccgatgttggcaggagtgaagaggtttggacattgtggttcatggtgtccagggaagaccagctgtggtcgggttgctggggtggttctcagtgggcccctccctttccctggtagtttggatttctctggctctggtggttttttagtactcattctatttacgggtgaagaaattgagaccaagagggttatttaccagagtatctcatcattggctgcataactggcattagaatctgatgtacttttatttctaatacatttctttttttttttttttttttgagatggagtctcgctctgttgccgagcctagagtgcagtggggcaatcttggctccttgcaacctccacctcctgggttcaagctattcctgtctcagcctcccaagtagctgggactacaggcacctgccaccacagccggctaggttttgtattttagtagagatggggtagcaccatgttggccaggctggtctcgaactcatgacctcaggtgatccacctgcctcggcctcccagtgctgggattataggcatgagccaccatgcctggcctttctttgtcgtttcctttctttctcttcatccctcctctccttttttcccctccccgctgcctcctcctgtcttcccttctttccttcctttctctcctttttattttttcctttctttttctttctctgtctctcccaacccttcctctctccctccctccctccccttctctctccccccctccctccccttctctctccccctccccttttgttcctaagagacagggtctccttatgttgctgaggctgaccttgaactcctgagcccagatgattctgcctccttagtagctgggactacacccacctcccgttccgttgtcatcttttttttttttttcttttttggagacagaatcttcctctgttgctcagggtggagtgtagtggcacgatcatagcttactgtaactgtgtaacctcgaattcttgggctcaagcaatcatcccatcatcccacctcagcttgctgagtacctggggctacaggtgtgtaccaccatgtccggctaattacttttcttatttttaatttttcggagataggatcttgctctgttgcccaggctggtgtcaaactcctgggctcaagtgaaactcttgccttggcctcccaaagtgttgggagggattacaggcatgagccactgcacccagcctcctctttcttcccatttaactcctaaccacaccgaactttctgtctgcagagaggagcattggtcagcagttcacaaaatggctaggtgtgatggcgtgcacccatagtcccagctacttggggagctgaggtgggaggatcgctggagcccaggagttcaaggccctgggcaacacagcaagaccttatctctggctgggcccagtggctcacgcctgtaatcccagcactttgggaggctgaggtgggtggatcacctgaggtcaggagttcgagaccagcctggccaacatggtgagaccctgtgtctactaaaagtacaaaaattagccaggcacggtggcgcgctcctgtaatcccagctactcgggggggctgagacaggagaatcacttgaacccaggaggaggaggttgcagtgaaccaagaacacgccactgcactccagcctgggtgacatagtgagactcttatctcaaaaaaaaaaaaaaaaggtcgtctgtactattgcatgttagtagtttctttctgcttattgttgagtagtagtctattgtatgcatgtaccagtttgttcatctagtggtggacattgagttagcaggttttggctattaaaaataaagctggaggccgggtgcgatgtctcacgcctgtaatcccagcattttggaaggccgaggcaggcggatcacctaaggttgggagtttgagaccagcctgaccaacatggagaaaccccatctctactaaaaatacaaaattagccaggcgtggtggcgcatgcctgtaatcctagctactcaggaggctgaggcaggagaatcgcttgaacccgggaggcagaggttgtggtgagccaagattgcaccattgcactccagcctgggcatcaagagtgaaactccgtctcaaaaaaataaataaataaagctggtatgaatatttatgtacaggttttgtgtgaacatatgattttatttctcttggttggaatgcatagaaatgagattgctgggttttgtggcaagtgtttatttttccagggtacatataatcctgtgagtgtttatttaattttaaaagtaattgctaaactgtttgctaaagtgactgctatattttctttccctagcagtgtatgaatttttttttgaggcagggtcttgctctgtcacccagggtggagtgcagtggtgcgatattgtctgactgcaacattgacctcctgggctcaagtgatcctcctgcctcagcctcctggctgggaccacaggcatgtaccaccacacctggtagtttgctttgatttttagtagagaagaggtctcactatgttgccctgggtggtgttgaactcctgggctcaagtgattcatctacctcagcctcccaaagtgctgggattatagatatgagcccctgtgcctggcctcattgtggttttaatttgcatttccctaatgcccagtgatattgagcattttttcatgtgtttatttgacattcataccatctttggtgatgagaaactatgtttatgcattgcttaatgatggggatgtgttttgagaaattttttcggtgatcttatcattgtacaaatatagagtttacttacacaagcctagatggtatacctactagacacataggctgtcgtacagagtattactcttaggctacaaatctgtatagcatgttgcggtactgaacactgttggcagatgtaacataatgttaagtatttgtgaatctaaacatatctaaacatagaaaaggtgagtaaaaatacagcgtaaaagataaaagtggtatatctgaataggtcacttaccatgaatggagcttgcaggacaggaagttgcttgggatgagtcatttatcagtggtgtgtgaatgtgcaggcctaggacattactgtatgctactgtagacaaacactgaacagttaggatacactaaattgataaatatctttcttattttgttttttgagatggagtctcgctctatcgcccaggctggagtgtagtggcgtgatgttggctcactgcagtctctgccttctgggttcaagcgattctcctgcctcaacctcctgaatagctgggattacaggtgcgtgccaccacacctggctaatttttgtatttttagtagagacgggggtttcaccatgttggccaggctggtctcgaactcctgacctcaggtgatccacccgccgtggcctcccaaagtgctgggattacagatgtgagccaccgcacctggccagagatgaggtcttgctgtattgcccagggcgttgaactcctgggctccagcaatcctcccacctcagcttcccacgtagctgggactgtgggtgcacgccatcatgcctagccgttttgtgaactgttgaccaatgctcttttctgcagacagaaagttcactgtggttaggagttaagacttttaacctctgacctcaagtgatctgcccaccttgacctcccaaagtgctgggattacaggtgtgagccatcacgcctggtcaaaaatatctttctttaagagtaaatttaccttaacttactggttgatcattgtatataggtctgttgttaattgaaacatgcgggccgggcccggtggctcatgcctgtaatcccagcactttgggaggccgaggcgggtggatcacaaggtcaggagatcgagaccatcctggctaacacggtgaaaccccgtctctactaaaaatactaaaaattaaccgggtgtggtggcgggcgcctgtaatcccagctactcgggaggctgaggcaggagaatggcgtgaacccgggaggcggagcttgcagtgagccgagatcgtgccactgcactccagcctgggcaacagagcgagactctgtctcaaaataaataaataaataaataaataattgaaacatgcggtgcatgtgtttatttgcgatctgacttgtttggaaatatttgcattatcttccttctagatttagagcatcttgacagtaggaacaagtgttttgtacaactttgtatgcttagtaagttatcaattaacttgtcgtggccaggcgcagtggctcacgactgtaatcccagcactttgggaggccgaggcgggcagatcacctgaggtcaggagttcgagaccagcgtggccaacgtggtgaaaccctgggtttgtttgtttgtttatttatttatttattttttggagacggagtctcgctctgtcgcccaggctggagtgcagtggcgtgatctcggctcactgcaacctccgactcccaggttcatgccattctcctgcctcagcctcccaagtagctgggactacaggagcccgccaccatgcctggctaatttttttatttttagtagagatggggtttcgccgtgttatctgggatggtctcgaactcctgactttgtgatccgcccgcctcggcctcccaaagttctgggattacaggcgtgagccaccacacctggcctaccctgtgtttattacaaatacacaaattggccatttgtgcgtggctcatctacagtctcagtgactcagaaggctgaggcaggagaatctcttgaacccgggaggcagaggttgcagtgagcagagatcgtgccactgtacttcagcctgggtgacagagtgagactgtgtctcaaaataataataataatttgttgaatatgtgactgttggtttaatttttatttttatgagatggagtctcactctgttgcccaggttggagtacagtggcgtgcagtggcgcaatcttagctcactgcaacctccgcctcctgtgttcaggtgattcagcctcccaagtacctgagactacagacgtgcactaccgtgcctgactaatttttgtatttttagtagaaatggggtttcaccatgttggtcagcctggtctcaaactcctattctcaagtgatccgcctacctcgaccttccaaagtggcggaattataggtgtgagccgtggtgcccggccagactattggtttggtttggtgtgatgttatgttatgttatgttatgttatgttatgttatgttatgttatgttattttaagacagagtttgtctcttgtcgcccaggctggagtgcagcggcatgatctcggcttactgcaacctccgcctcccaggttcaagtgattctcctgtcttagcctcccaagtagctgggattacaggcgcccaccaccgtgcctggctaatttttgtatttttagtagagacagggtttcaccatcttggccaggctgttctggaactcctgacctcatgatccacccgccttggcctcccaaagtgctgggattacaggcgtgagccactgcgcctggctgactattggttttattattaagcagtagtagttgaccctgtcatgtagaaagcatggcatttataggcataccacgtttaatttcctcccctttttttatttttggagtacctcctgcttgtgaggcttgggaatacagtagtgaataagccagatgaggtctctctctttttggagcttatgtggtagtatagactaggcagaaagttctcattgcccctgccaccttatggcattgaggtgtttgagatgctgatgtttacttctgtctcataaaatcttgaaaggagttcttttagatgaagaggaaaacaaaatcagaagaatgggcctgggtcatgtctgtaaacctccccacgtcatggggaggctgaaatgggaagggccaggagttcaagaccaggctgagaaacataacaagaccccatctctacaaaaaatattttttaattaatgggggatggcagcacacacctgtagtcgcagctactacgaggctgaagcgagaggattgcttgagctcaggagttaaagattgcaggagctatgatcacagcactgcgctccagcccctcttatcagcagtctggtatgttgctaagggtcttgttctttttagtgcttcagggacagccactggctatgcccagaaataagtatgtttgagaagctttctgacctcagcttgaaaaattgattagggtcataattaaaaagggagggaaacaggattgagtgaaccggacgctaccgtgagtttattctcccagggcatacataatctcatgtgattaccacatagccctgttagataatctgttatcctgtcctcattttacccatgaggaaatgaaggcccagagaggttaaatgacctattcaaattcactcagaaggtggcagagatgagttactatcattgtattttggatctctggaaagaaagaaaactagtgatggtattaaaaaatgttattaatagtttcttttaatcaaccaggaacttgagtcactagcttctctgggtgaaggactatacttcaacagtatgaaaaacggaaaagaaaatgaggaattttggctgggcacagtggctcacacctgtaattctagcactttgggaagccaagggaggagggtcgcttgagctcaggaattcaagatcagcctaggcaacatagtgaggccccatctctacaaaaataaattagctgggcatggtggtgcatgcgtatagtctcagctacttgggaggctgactcaggagggtcacttaaacccaggaattggaggttgcagtgagctatgattgcgccactgtataccatcccaggcgacagagtgagaccctatccccccaccgccaaaaaaaagaaaagaaaatgaggaatttacatttgtgacagatacggaattcagggaatttagttgttcatagtctataaatgctataagaagtctccatacctttttttttttttttttttttttttggagacagagtcttgctctgtcgcccaggctggagtgcagtggtgcgatcttggctcactacaagctctgcctctcgggttcacgccattctcctgcctccacctcccgagtagctgggactacaggtgcccgccaccacgcccggctaatttttttgtatttttggtagagatgaggtttcactgtgttagccacagatcccgacctcatgatctgtctgcctcagcctcccaaagtgctgggattgcaggcttgaatcaccgcacccggccggaagtctccatactttttaacccaatctaaaatggtaaggaaatatataagaatgtctatttattattaaattttttctatataaaacatttcagaaaataaagactagcatttctgagccaagtggtagtagtggccattttttctggaaaaaaaaaaaaaaagaaagaaaaaacacatttagctatctatgatgtgaaaagatgaacattttatttaggtaataaatgttatgtcataaaataccatttattgtgtgcctattaggtttcaggagagctgtgccaagagcattacttgtatatcttttaagccttacaacagcccagcctgtcaggctggtagtgccatatctgttttacagatgaggaagtgatggattggagaaattaaggaaattgcctttaggtcaaagagataggaagtgacaaagctgagatttttaaccttgtgagatttcaaagtctttgctttttaataactgttccattgcttctaatatagagatatgacaaaaacaagtaaaaatcagtgaagaaggctgggagcagtcgcttatgcctgtaatcccagcagtttgggaggccgaggcgtgtggatcgcctgaggtcaggaatttgagaccagcctggccaacatgacaaaactccgtctctactaaaaatacaaaaaagttagccaggcgtggtgacaagcacctgtaatcccagctactcagtaggctgaggcaaggagaatcgcttgaacctgggaggtggaggttgcagtgagctgagatcgctccattgcactccagcgtaggcaacaaagcaagactccgtctcaaaaaataaataaataaataaataaaaataataacaataatgaagaaaacaatccggtgattattgtcagcaataaaatttcttcaatcaaccatgctttagtcctggcagttctctatcagtgagtttcaatcaaaaagtttgtttataatttttttttttttaaaattttgaaatttggaaacaacatcataaatgatggttagttttctgcagctccctattttggcagatagtctgttgttactcataattaatttgaactaaaaagtagtgttgtacgatatcatgggctgtgaatgtgtttgtgacttgatctgagaacccacacaccacttaggatgcttctgtaggaaaattagagtatggaactcacttgcccacgctttccctgtctcagtccatgttggtaggctgcaaagtctggggctagaaggacactgaacaagacttcagcagtacatgttagtcttccagagggaaggaatataatagttgagagaataattcctttcctctgtgactttaggcaaattcttggctatgctgttatttatttgggccaaacaatatcaggaggttgtacattttattcttaattactgcgatacattaattttatccatgggtttaacctagcctaccttttgctgttagacttcaactctacttgtgttgggttacccctctgcttaaaaatcaccctattcccaagcctgagggagtctaccttcaaagctttctatgacctaatccaaggcctgtcaaacttcgtaaagggccagatagtaaatttgttttttttttttgagatggagttttgctcttgtcacccaggctggagtgcaatggtgccatcttggctcactgcaacctctgcctcccaggttcaagtgattctcctgcctcagcctctcaagtagctggggttataggcatgtgccaccacgctcggctaatttctttgtatttagtagagatgggggtttcaccattttggtcaggctggtctcgaactcctgacctcaggtgatccacctgctgcggcctcccaaagtgctgggattaccagtgtgaaccaccgtgcccagcccgatagtaaatattttaggctttgcagtccatatacagtcccatttttttgtgtatgtttgcacgttttctttacatattttaaaagcccctttttttttttttttgagacagagtcttgctgtgttgctcaggctggagtgcagtggtgcaatcttggctcactgcaacctctgcctcctgggttcaggcgattctcctgtctcagcttcccgagtaactgggattacaggcacatgctgccacgcccagctaatttttgtatttttagtaaagatggggtttcgccacattggccaggctggtctcctgatctcaggtgatctgcccacctctgcctcccaaagtgctgggattacaggtgtgagccaccgtgcctgacctaaaagctctttacagtgtaaaaaatattctgagctttaagccatgtgaaaataggccatgggcatttgctgacccctaatagaactccattttacctttctgatcatgtttcccattaactcttcaaaaatatgacctccatttaaatcaagatggtctccttcctcactgcttgtggaggtccagtgcccagtgtctgcctcttgcttgctcctccatcattgttctgccattcgagatcctcatacttaccctttaagatctagcccaaattttccatgaaactaattctaataattaaaaacttcctgtagaacttaactttgtctagtacaagttagctttcttattcagtagtagcttactataaattacaagaataaaaagattaccattttccctcacactgttttgtggagaatgcctaaagttactttttctttttacaggtcagtattcctatttggcatcctaatcccctttcccaaatctgaattttgggatttgaagcttgcatttgagattatgatttgtcttccttgttgtacacaggagcagggactttacaattagtattcgcatccctgctccttcatacttcgtgatgtaaggcaagttattttcacttatgcttaagtttcttcccctgtaaaaaggggatggaagaggattaaatgaattaaacatgtaacacgcttaaagcaatgcctggcaagtaataagtgctcagtaacttttagctgttcttattagcatgtttggaaaccagtagaaactacaccagcaagttaaggttgaaaagtggtattgatgggcttggggtagtacagtatgaatggctacagtttagcgtttcattaagtttgtatattcattaattcattacacatttgatgctgtcagactaggacagagacaaagatgaatgaaacattatctctgcttccaggttacccagtgtagtagagaaggcaggcatgcagatagtttaaattggtagcactgggaggggactgccatgggtgggcagtgaagaaaaagggcttcaaaataatgagagttgagatggatcttcaaggaagataagcagttttcagtaaggccatgaagagaggaggaagttccaggcgggaagagtttgtgctaaagtacagggattgctatacacatggtgtatgtagaaaaaatttggttcacagtgtgatagaagaattggagggggtcctcactgaaagtaaggaaacacatttggaagaatatgtttcagttagaaaatgaaatgagcttaaagtaaacgctaataaggtttttaaaatgtaaaatttcaacgtatttagaaagagaacagctggatgaatcttatgtacctgtcactcagctttagcagttatcagtaaatggccaacgttgtttcagctatactcccctctcctccactgatagtcttttgaaggggaatacaattgttttgtggcctccagaaagggataagtttatgagcaacgggtagatcgttgggagagacttgagtttcctgtcaggaagcattcttggtgcataagtcagaggtgatatgaatgccgtggaagggggtggcttactgtctggagaactcgagaagatgggaatgggcactgtccagtattgtggctacttccacacatggttctttaaatttaaaattatgttgattaaaatttaaatatttcagttcctcagccatactaatcgtatttcaagtgcttagctgccacatgtgcctaatggctgcaatattggacagcatgacataggacatcttcatcattgtacaaagttctcttggacagcatgggactagagccctaagatccttttctacctgagttgtttggattttttggtgtgtctaggttggatctagttgttcatggcttcatgaccaagccttttatccctttctctagagggactcaaggggtaaaggcactgaaggggtaaaacttcatatgaagagtgtggtggtggtggtggtgttttaagacagggtctcgctctgtcactcaggctggagtccagtggcatgatcctggctcactgcagcctcgacttcctgggcttaagtgatcctcccacctcagctcccaagtaactggaactgtaggcatgagccaccacacctgcctaatttttaaaactttctgtagagacgagatttcgccatgttgtccaggctggtctcaaattcctggactcaccttggcctcccagagtgctgggattgcaggtgtgggccactgcgactggccttttttttctcctttactactctagtgtatgctggaatatgaggaaataattatattagctagcagttattaaacacttaataacataccaggcactgttttaagctatgcgatctgtatggaatattacttaatttccacaaccttatgaaaagatactattttttttcttttgagaaggtactattttcatcttcatttcatagatgttgaaattgaaacacagagagctgaagtcacaggattaaggccacagagctgagaagtgatggagccggaatttgaacccaagcaattaatgctgatattagttcttgtgtgaatggtaattgttttgaaacaatgatcctagatgattatatgaccggattaatctggcagttgttctgtgtgaatttagagttgccttcccacctcagtttcctaaaaacaaaacaaaacaaaacaaaacaaaaaaaactctagcttcactgtgtttgggttgtcatggcctaccccctcttgccacctcatttgactcaactttttagggagaaaatattcaatacgtggtataggatttccctttctaataataatgtaaacaacaacaagaagtctgaaattggaagaacaaaatgactcacctaagtgagttaaccttaagaggtggaacttgatttctagattttagttaattgtctaactgatgtactaaatattagttacttaagtattaaaacgggtagacataatagttggggagctgctgtagagggggtagtttgagaaggcttctttcaggaggtgacatttaagttggtaactaacaagaaaggggcagccatgtgaatagctggagggaagagcattcttacagttttactggaagggggttagaggtatgtggtacccttatgccaaagaaaattagttacttctatacaaccagtctgattctagaaacctggatcaatgaaatattttgattatataaaaaaatctgttacccaggtcttgttgaaatagcattagaaactactgaaggacatatagaggaggagtgttgaaaaatggtgatggatgagcagaatggtgaaaaataaaaagacatgaagctctataattatattgtatggtgacagtaccaatagagattgcatgttttttctccccagtttttttttttgttttgttttttgtttttgagacagagtctcactgtgtcactcaggctggagtgcattgtcgtgatattggcttactgcaacctctgcttcctgggttcaagcgattctcctgcctcagcctcctgagtagctgggattacaggcatgtgccaccacgcccggctaatttttgtatttttatttgagaggggatttcaccatgttggcaaggctggtcttgagttcctgacctcagataatccacctgcctcagcctcccaaagtgccgggattacaggtgtgagccactgcgcccggcctcccccagttgttgaaacaataatggaaggtaattttattcttagattatttaatgtttttcagttatcaggatgtgttagattgtttgtgtatattgttttgcttgttaattaagtaacacagtgaataagacagacaaacatacgaaaatgtacatttattttatttttttgagacagtctgttgcccaggctggagtgcagtggcccaatctcggcccactgcaacctctgcctcctgagttgaagcgattctcttgtgtcagcctcatgagtagctggggccatgggtgcacgccaccatacccggctaatttttatatttttagtagagatggggtttcaccatattggccaggctggtctcgaattcctgacctcaggtgatctgcccgccttggtctcccaaagtgctgggactacaggcatgagccactgtgccaggccatttcatttttggaacgttcttttttttttttgaaatggggtctcgctctgtctcccaggctggagtgcagtggctcaatctcagcttactgcaacctctgccttccgggttcaagtgattctcctgcctcagcctcctgagtatctgggactacaggtgcatgccaccacgccaggctaatttttgtatttttagtagagacggggtttcaccatattggtgaggctggtcttgaactcctggcttcgtgatctgcccgcctcaacttcgcaaagtgctgggattacaagtgtgagccaccacgcccggcctgtttctggaatattcataatcttttgttgtcatttcaacagtgctcacagcagcttcaccaggtgtagattccatcttaagaaaccactttctttgcttatccatgagaagcaacacctcatctattcaagttttatcatgagattgcagcaattcagttacatcttctgaccccacttctaattttagttctcttgcttttttaccacatctgcagttacttgctctactgaagtcctgaacccctcaaaatcattcatgagtattagaagcaatttcctggttgggcacggtggctcatgcctgtaatcccagtactttgggaggccaaggagggcggatcacctgaagtcaggagttcaagaccagtctggcaaacgtggtgaaaccccgtttctactaaaaatacaaaaattagcggggatgtggtggcgggcgcctataatcccagctacttgggagactgaggcaggagaatcgcttgaacctgggaggtggaggttgcagtgagttgagattgtgcccttgcactccagcctgggcaacaggagcgaaactctatcttaaaaaaaaaaaaaaagaaaagcaatttcctctaaaactcctgttaatgttgatgttttaacctcctcccatgctcatggatggcattctcagtggcatctagaatggtgaatactttttagaaagttttcaatttattttgccatcagagaatggctatgaatggcagtagtagccttacagaatgtatttctttttttttttttctttttttttgagatggagttttttttgctcttgtcacccaggctggagtgcagtggcatgctatctcggctcaccgcaacctccgcctcccgggttcaagcaattctcctgcctcagcctcctgagtagctgggattacaggcatgcaccaccatgcccacctaattttgtatttttagtagaggcggggtttctccatgttggtcaggctggtcttgaactcccgatctcaggtgatctgcctgcctcggccttccgaagtgttgagattacaggcgtgagccaccgcgcccggccgtatttcttaaataaaatggcttaaacgtcaaaattatcccttgatccctgggctatggactgattcttgtgttagcagttatgaaaacatttatgtccttgtacattcccatcatagctttttgtcaatgagaagtaattttttttttttttttgagacagaatctcactctgtttcccagcgtggagtgcagtggcatgatctcagctcagtgcatcctacaactctgaggttcaagcaattctcgtgcctcagcttactgagtagctgggattacaggcgcccaccaccacgtctggctaatttttgtatttttagtagagatggggtttcacgatgttggccaggctgggctcgaactcctggcttcaagtgatccacctgccttggcctcccaaagtgctgggattgtaggtgtgagccactatgcctggcctaattggcctaatttcaatattgttatatctcagggaatagagaggcacgaggagaaagagagacaagctgactgctggttcgtggagtagtcataacacacaacatttattaagattgctgtcttatatggaccgtttgtggtgccttaaaagaaatcagggtaacatcaacgattactgattacagattactataacagatacaataataattgtaaattattatttacaattgtaaaatacaatcttttctttattatttacaattattgtaaaatacaatctgattacagattactataacgtatacaataatagtggaaaagtttgaaaatattgtgagatttatgagaatgtgacacaggcgcaaagagagcacatgttactggaaatacggcactaatggacttgcccgactcggggtttccacagacggtcagcttgtcaaaaatgcagcatctgtgaatttcaataaagcaaagcagaataaaatgaggtatgcatgtattgccatcacatgtacactagtaaaatacgttttttttttcagtaggtggatcaacctcaaattttaatataaagcattacttaaaggagaatatggggacattcatgacatttcttatatgtacataaaacttcatgaaaataatttaatgctatccagcagtttattttagaagtactggaggctaggcatggtgtcttatgcctgtaatcccagcactttgggaggctgaggtaggaggatcacttgagttcaggagctggagaccagcttgggcaatatagtgcgaccccatctctacaaaagagaaaagaagtactggagtgttgcagctcttacagaatttgtctagcaggttttccagtctttaccagaaatgcccccatgcagaagtagtaaatactgattcatgtaaaataataaacaactttatctttcagtttttaaaagacagggtcttgtaacgttgcccagactggcctttaattcctgggctcaagcgatcctctcacctgagccttttgagtagctgagactacaggctgcacctctgcacctggctctgcttgatttttaattgttgtattgctgttgcagctatgtttttttttttcttcagtgtgaggatgggcaaactttttatgtaaagtctcaggtaataagtattttaggctctagggccatatagcttctctgttgcatatcctttttttttttttccatttcccctcaaattccttttaccataagcaactcttgaggaacataaaaatcattcttagcccagaagccagaccaaaacaggttgtgggctgtagtgtcctgacccctgatttaaagattgatagctttgaaatggaaagttttaactttctttttttttctttcccttgttctgattgggctgttaattcattaggtatttactcagtgtgtatcatatgaggcatgattcctctgctaattttggtagtggtagaaagatacttttgccaagcttggttgttaggttttcatttgtccaagagttcctgaccaagtgtgaatggatgttgaaatcaaggtgtttctttggccacacaatgtgcctttgggggctatatctatgtgcttctggtaccttcttttaattttcacaaagacactgcttgccgaccacactgttttgtctaatgtggggctatgaccccctggaagaggcatcattttctgattttcacagaagcataatatggtcaggtgatggtcctgagtagtgggtatatgacagatacactagtaattataatacagatctaaactggagagttgaaaacagcatcgtatatttgattgagataatcgaaggaagacttcctgaaaagatggcatttgagtttcaaggctgagtaggattaagtattattatttaaaaaatgccttggacaatgcattaaatagagttaacaaatcacatcacttatagtctccaattaaaaacattttacttaaacataattttagacttttagaaaaattgcaaagatattataaagaattctcctatatatctcacctgtattcttcaagtaacattttaccatattcaccttaacattttctctgtattggtaattgtatatgtaagatttaatataaaataaaaattcttattaaacatatgagagacatgatgcctctttagccctaaatacttcaacttgtatgtactaataacaagggcattctatttcaaaaccacagtacagttgtcaaaataaggaaattaataattgtgtcaaactgttattctgtttatagaccttctaatgtcctttaaaacaatcaacaaatcaacatttttctggtcaagaaccagtaaatatgtatattctacatatatatatacacatatatatacacacatatattctacatatatatgtggaatatacgtatttactccctctgtccaagaaccaatccaggattgttaccttcggttatcatgtatctttggtctcctttaatccaaagcagtttctttgtcttttatgacttgacacttttgaagattacaggttattttgtagactgtccctcaactagggtttatctgaggtttccttatgattagattcagatatttatttttggcaggaatacaacagaaatgatttgtgtgtttttctcattgcatgatatcagaaagtgcattgtatatatttatcccattactggggttgttaactttgatcacttggttagagttgtgtctactaagtttcttcactataaagttatttttcacttggtcatttcatcagtatcttgtggggagttactttgtggttatataaatactctgtttctactttcccttactatatttagcttctgtggacacttttgcctgaaacagttatttactatggtgttaccaagtagtgatgcccttttcttccatcattctgtctacatttttttttttttttttttttttttgagatggagtttcgctcttattgcccaggctggagtgcggtggcctgatcttggctcactgcaacctctgcctcccgggttcaagcagttctcctgcgtcagcctcccgagtagctgggattacagacatgcgccaccactcctggctaattttgtatgttcagtagagacaggatttttccatgttggtcaggctggtctccaactcccgacctcaggtgatccacccacctcagcctcccagagtgctaggattacaggcgtgagctgccacaccaggccttctttttctcttttaagagatagagtcctgctttgtcaccaaggctggagtgcagtggcatgatgatagttcactgcagcctcaaactcctgggctcaagtgaacctcccatctgtagctgggactacaggcacctgcataacacctgactgttttttaaaactattttagagatggggtcttgcgaagttgctcaggatggtcttgaactccgggtcttaagtggtccttctgcctcagcctctggattagttggcattacaggcatgagccattgtacctggcaagtgcatattttctttttttttttttaaggtggagtctcgaggccgggcgcagtggctcacacctgtaatcccagcactttggaaggccgaggtgggtggatcaagaggtcaggagatcgagaccatcctggctaacatggtgaaaccctgtctctactaaaaatacaaaaaattaactgggcatggtggcacacgcctgtagtcccagctactcgggaggctgaggcaggagaattgcttgaacccaggaggtggaggttgcagtgagtcaagatcatgccactgcactccagcctgagcgacagaggtagactctgtctcaaaaaaaacagaaagacggagtcttgctctgtcacccaggctgcattgcagtggcatgaactccgcctcctgagttcaagcaattcttgtgcctcagcctcccaagtagctgggattacagacatgtgccaccacacgtggctaatttttatagttttagtagaggtggagtttcaccatgttggctaggctggtcttgaactcctgacttcaggtgatccacccgccttggcctcttgaagtggtgggattatgagtgtgagccactgtgcccagccaagtgagtatttgcttatgtagtattttaattttatgatttttttttctttgagacggaggtttgctcttgttgcccaagctggagtacagtggtgccatctcggctcactgcagcctccacctcctgggttcaagccgttctcctccctcagccacctcctcctgaatagttgggattataggcgcctgccaccatgcctggctaattttttgtatatctagtagtgatggagtttgagcatgttgccaggctggtcttgaacctctgacctcaggtgatccacctgccttggcctcccaaagtgctgggattaaggcatgagccaccatgcccggccagagactgttcatttattttttttttttgaggcggagtctcgctgtattgcccaggctggagtgcagtggcacaatctcggctcactgcaagctccgcctcccaagttcacaccattgtcctgccttagcctcctgagtagctgggactacaggtgcctgccaccacgcctggctaattttgtttttgtatttttagtagagatggggtttcagcccgccttggcctcctggagtgctgggattacaggcgtgagtcagggcgcctggccaatcataccttcttttactgcattaattatggttttctttcgttcttaaaacatgtttatagtgaccacttttgaaattcttattaagtcagacatctggttatacaagcaatttctattgcctacttctttttccagtgggtggggttatactttcctgtgtcttagcttgtcgtttttttttttgttgttgaaaactggacattttaagtaatgtagtaactctggatacctcattagcctatggttgggggtggtggttgttactgttatttgcttatttgtctaatgactggctgaatgattttagtgttctatccttcttccctccctgtacagtgtgacacgtctgatgctagttttcttgggatgcagccttgggtatgcctaccatcactctagaatcacagtgattttggcatggctttgtctcttttcctgactgtacccagctgttaagctacactaattactaggtgatgctgtgtagtcatttcttggtgtccttgggggattggtcccaggacccccccgttggatataaaaatttatggatgctctagtccctcataaaatggcacagtatttgcatataccggtgcacatcctcctgtatgctttgtcatttctagattacttataatacctaatatggtgtaaacactaggtaaatagttgttatatattttttatttgtcttatttttattgtatttatttttaagtgtttttaatctcgagtgattgaatctgaggatgtgaaatctgcagatatggagggcctgcattgttttccgtggagctttgggcctaaactgctccacagactgatctgatcaaatttgcgcttctttgaagggatagtttctgagatcagtgtttgaaatttgttccaatccacagaggagtcctcccagctctctttccctagttctggccaccaaactagacaactacaatttagcacttatctccaatgattctcctcctaccaagtgcctttgaaagcatcattaactctttcataccttgttgcaaatgaaatttctttgggaagagattgtgagttttttttctcctaaattatggtgcaatataagtaatataccattttaacaattttaagtgtattaagtgttttttttttttgtagtttttttttttttgttttttgagatagtcttgctctgtcgcccaggctggagtgcagtggcacgatctcggctcactggaacctccacttcccgggttcaagtgattctctggtctcagcctccccaaatatctgggattacaggtgtgcaccaccacgcctggctaatttttctatttttagtagaaacggggtttcaccatattggtcaggctggtcttgaacttctgagctcgtgatccacccacctcggcctcccaaagtgctgggattacaggccttagccaccacacctggcctatgcattgcttttatatgtattttaaaattcataagttctcctcctatgatgtttttgtcccatgtgatttatttgttaaaccgtcatctttggccgggcgtggtagctcacgcctgtaatcccagcactttgggaggctgaggtgggtggatcacaaggttaagagatcaagaccatcctggccaacatggtgaaaccccgtctctactaagaatacaaaaattatctgggcatggtgacgcgtacctgtagtcctagctacctgggaggcggaggttgcagtgagccaagatcgtgccactgcactccagcctggcgacagagtgagactctgtctcagaaaaaaaaaaaaacaaaaaactgtcattttttatgttgcatttactgcattctggatttaaactgtgaggaacctcatggtatcagttaatatattcttccatcttaatgtttctcgtaaactggtagatctgtaaacttgattaggtctatcctattgtatcacatcagaagcagaaggtgcttttttttttttttaagggaaattgtgtgaaagtagacagaatggtaaagtgaacccctgcacacctatcacccagctttaatagttatcagctcataccattcttgtttgatttacaaccccattcatttctcccttctgtattattattatttagttaattattttttgagacagggttttgctctgtcaccaatgctggagtgcagtggcataatcacagctcactgctgtcttgacctcctgggctcaagtgatcctcccacctcaccctaccaagtagcggggaccacaggcgtgtgccaccatgcctggctagttttttattttttgtagaaacagggttttgctttgttgcccagactgatctcaaactccggcactcaagtgatcctcctgcctcagcctcctaaagtgctgggattacaagcatgagctaccacattcagcatgtaaatttctttatattaatttgactggcattttaagtcacacttgaatttcatatttggcaactattaaaagcatagagtcctggatattagtgttttgttaaacctgatctatctaatcataaatatacttaggtctaaaatatgctcttggcctttgtttattgcggttcagtatttgttactatattaaatagtaaaatatttggtttgagatactaatgaaaagattaaaagtaaagcataacttgaatggatacaaaaagaaacaagaatttagacttcagtggatttcagagaatactgcttcgatatgctaacattcctgttgggtgtccaaccgtgtcatagatcagtggaaattagtggtttctgcactttactgtactgtttttttatatgataatattttcctggttgaatgattcgttcttttgagtaaactccatggtcaaacaattactttttattagtcaaagatgtaaccacataatcactaaaaagaacagtgtgacttatttaaaggggattatgtttttaagtcttttatatagctttgtagggaggccatatgagtttaaggacagttcgtggcatttgttcaaggttttgtaacttggcatctcagcagccaccaggataccagatcatcgttctaagtaagatttaggcattttagccttcatgtacagactataagtacacccccccacacccctaccaaaactgtaaattcaaatgatgtttgaaaaagcatagaatttttgttaggcgaggtagtttattccttgtgatacagttccagagaggcagcataacctaggaatgaaaaacttagacgtggaatcagatacacctggtttaaataccagctctactgctcatgaactggatgattttggtcaagatacttgactgctgaggttcagtttcctcacctgtaaagtagaggtgatagattagacatgttgcatgtgaagtacttagtatggtgtctggttttgtagtaagatctataaaagataaattattagtcatattccttagacttcaggaatttatctctgtgccatgtttgaggcaaacagttacagaattagaatgttagaaatgaaaggaatcctagatgtcatttaattcaagtccattgttttctggatgagagaagaaagtgaggaaaagtgacagagttggagaccaagctaggactggcctcagaatgttaagagtactcttctagggatcgaccagtcgtgttactagactttttggatctgaattgtgcttttccttgaatgttttgaattttggcttgagtgttgtgattattttattaaaatgagattccagtcctattgtcatgactaatgtttatgagaaatataacatttcactttaatgatgttttttaattattctaaggggcctaatctttttcagtggaataagctttaggttgtattatattctataattcacttgaaaatagaattcatctttacttgacagccaaattttgtgtactgcatcttttctgagggagagagttggcaaggaaaggcacttgttacaacgatccacacatatagacgcatattatttagaaatgaaagtgctttgaatgatttagcttattttcagtttttttttttctgcagttgtaatcatatgacctgtttttctttctttttttttttttgagacagagtcttgctctgtcaccccggctggagtacaatggggcggtctcagctcactgcaacctccacctcccaggttcaggcgattcttctgcctcagcctccctagtagctgggactacaggcgcatgccaccacacctggctaatttttttattcttagtagagatggggtttcactgtgttagccaggatggtctcgaactcctgaccttgtgatctgcccacctctgcctcccaaagtgctgggattacaggcatgagccactgcgcccggcccatatgacctgtttttcttttatagatgggggagaaatatgggaagtgacttggtgtcagtcatctgtgttggttaaatcaagaatataatccgtgttttgcttctgaatagctctttataacagtgattggttactttgggagtaaagattattatttagagacagagtcttgctttgtcgcccaggctagactgcagtggaatgatcgtagcctactgcagcctcagactcctggactctggtgatcctgcctcagcctcctgagtagctaggactagaggtgcatgccacatgcctggctataattattattaatttacgtttagcattagtttttttcttccagtaggctattttactttatttatttgattttgatgaagtttgattatttctagtttgcttccttctatgacccctacctgttgtgggtctccaggcaagcagtgcataggtagagccatccttaggtagcctttagacttaatattaggtgagctctccccacagatagcctctcctttatttgaatggaattatattttaagtttggaaatatttttcagcttatttagcctgttgaatttaataaaaataatatttaatcttttcagaggtcgaaacagtaacaaaggactgcctcagtctacggtgagtaactttaatgttacttattggggaaaattagtagctaaaacatgatctctaaccacagaccaaatgccaaggcaaaagattcccttcttttgaattttgtcatagataacttgactgtttaagtatgttattagcctatatgtgtttttttaatgactctgtataaaatgtacaattacttgttgtattagtccattcttacactgctaataaagatatacctaagactgggtaatttataaaggaaagaggtttaattgactcatgctctgcattgctggggaggcctcaggaaacttacaatcatggtggaaggggaagcaaacacatccttcttcacatagcgacaggagagagaagtgctgagcaaagcagggaaagccccttataaaaccatcagatctcctgagaactcactcactatcatgagagcagcgtaggggaaactgcccccatgattcagttatctccacctggtcttgcccttgacacacgagaattattataattaaagataagatttgggtggggacacagaaccaaaccatatcatttgtaaatagtatttttgtcacgtgtaataacaagaacaagtcgcttgttcttttctaaatgactaagtgcaaatctaagtgaaaaacctccaaaagatacgtagaacaccaagagtggagtctgcagagttctttatgctttttattttgaattaatgtgctttttttctgctgctttcatttttctcctttggctttctggtcttaaattttggaatgttatcaatgaaattgaaccggacatgaagggcagaaactataagtcccacatgatggaagaaataaatgagaagctatcacaaatttttgagactttgcctttattagattgttttacaagaatcaggaagatatacacgtatatggtagtaatatggagtagtgtggttgatcagacttaagcactgtcactgatgctgatatgctgggagaacctagtcagggttcttctatgaaggtatgacctggcttcctaccccatttatttatacttcacccttcttagggtacatttctgtgagttttaacaattgcatacaatcagtgtaactaccaccacaatcaagttaatagaacagtttcattgcccaccaaaatccctcaaatcacttttcagtgaaccctcctctctctccaaccattgatttgtcttccatccttacggtttgtgtccttcctcctctatggaagtttactcttgcttttttatgtcatgtttagtcaaaacaccattagttggtttgactgataacacttgaaaacctgaccttctgttccttctgttctctatggaagcaaaatattaaataaacaaaatcttcccttaatacatgtaagatatcataaacctaactaaacattttgcaacaaataataaacgttagctttatatgcaaatgtaaatacaggctgagcatccctaatcggaaatgctccaaaatttcatattttgaattagggatgttcaagcactaagtataatgcaaatatccccaaatccgaaaaaaatccgcagtctaaaatacttctggtcccaagcattttagatgaggaagattcagtttgtactaatttctaatagttttttttttttttaatattccagatttcttttgatggaatctatgcaaatatgaggatggttcatatacttacatcagttgttgtaagttattagattattggggataaactgccttgggggtagaataaagtaattccatgaagttaaaatgtggataaatgattgtcaaagtaacattgcttagatcatgtttagtcaggatgatttagagaaatagattagaactccttttatccagtctaatataattcattgtaaaagtacagttggtcctctgcatctgtgggttccatattcatggattcagccaaccttggatcaaaaatatttgttaaaaaggccaggcacagtgactcacgcctgtaatcccagcactttgggagtttgaggtgggcagatggcttgagctcacaagtttaagaccagcctgggcaacatggcagaactccgtctctacaaaaagtaaaaaaactagccgaacgtggtggtacgtgcctgtagtcctagtgacttgggaggctgacgtgggaggattgtttgagcctgggaggtggaggtttcactgagctgagataatgcccctgcactcagcctggtcaacagtgccagacagaccccttctcaaaaaaaaaaattttttttttttttttttttttttttttttttgagaaaaaagaggcatggttgcgtctgaaccaaagatgtacggacgtttttcttgtcattattcctaaaacaatacagtatgacaatttacatagcatttacattatattaggtattacaagtaatttagggatagtttaaagtatttgggagaatgtgcttagttatatgcaaatactattacattttatgtaagtgacttaagtattatgtaattcggtatctgaaggaggtcctggaaccagtcccctaccaataacaacagatagctgtattcttgttaaccctgctgtgtgtgtaaaataatgttagtagttgattgtcttttgtacattattttgtcacttaaaatagctggggtcagaaatgtttgacttcagtattaaaattcgtactgcaaactctgagtagagcctcctgaagaatttcaagagttcagtgtattgttaatgttttgaaatttttttattgttttgttagtgaatacctaatattgaatgaagcctgatgaggtataaaaagtaaaatgaaaacaaatatccctggtgaccgggtagtatactgtttctttgataaataaattatatgtttttagggctccaaatgtgaagtacaagtgaaaaatggaggtatatatgaaggagtttttaaaacttacagtccgaaggtaatttttactttttttctttttcttacaaagtaaaagaacattttcatagtcagtgttttacctagtttttaaagccactttgaatgattttacttctcagtttcaaatactgattattttatagactggtttgtgtaatcagagaggcttcttgatgtgtgtgcttattaaaatatttcaaccatttttaagcattgtgagctaatagagggatgtggtggtttgttttttcctcttaaaaattattattaatgtacttaagacaaaccatagaaacaaaaaacatttagatatgaggatttttaaatgatggaatggataatagatcatatgcctgggaaaaagggtatgattctcttgagattatttttgtcaaaggcatataagaactggtaccttgatgagctaaagaattcctaacaaattttattttgtaaaggtttggagtacttacttgtgtttttcattttagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagaggtgggttttgatttcctaaatatgcctcatggtttattagatttattcaagcaaagattttcacagtgatcttacaaactttttttaaagaaatatctgggctgggtatggcggctcattcctgtaatcttagcacttagggaggctgaggcgggtggatcacctgaggtcaggagttcgagaccagcctggccaacatggcgaaaccccgtctctactaaaaatacaaaaatttatttttgtgtgtggtggcgtgcgcctatagtcctagctactagggaggctgagacagaattgcttgaacccaggaggcagaggttgcagtgagctgataccgcaccactgcactccagcctgggtgacagagcaagactccgtttcaaaaaaaaaaagaaagaaaaaagaaatatctactttctagaatagcccaagtaaggtaattttttagaaaaatgagaatgttaatgcatttttgttggaaaacaattagaactttagagaaaaattaaatagagtttttgtgatctcttaaaaaattagtttgtaaagcattttctacagttttgtggtcaagaatgctactgattatattcaactgaaaatttcttgtcccatttggcctacaatgctttagtttataagtgggcatgtggcaaatctggaaagaaatcaaagtataaggctaaggaagaaaggtagagaacggttggtagaaaacaattgtctaatgaaaatgaaaaagggtgaagaagtagaacatacgtattttaaaaatattcagagtatgagacaaggttttgagaatttaaaagcgattatgtagttatattaaaaatttagtctctttttaagtgtccattgatgaacaaagtgggaattcctgttactcatttgcaaggcattattgagtgttcagtaacacgttgcaaggcacttctgggcaatcctgaacttggttctcaaattctttttttttttttttttgagacggagtcttgttctgtcccctgggtggagtgcagtggcacgatctcggctcactgcagcctctgcctcccaggttcaagcgattctcctgcctcagcctcctgagtagctgggactacaggcgtgtgccaccacaccaagctaatttttgtattttttgtagagacagggtttcaccatgttggccaggatggtctcgattgtttgacctcgtgatccgcccgcctcggcctcccaaagtgctggaattacaggcatgagccactgcacccagccggttctaaaattcttttatttatttgtatatgccaaattctgtagtgaaatacgtaattctgttgtaaattgtagttcagtacaatttgattttcactattcaaatctataccaaaagctgtttttattgttgggctgattcttctacactgttacttggaaataataatataccaggattctttctcttagacttaggagtctttctctttgcttgctttttcagaggctaacagtactgggtattctttaactgtcttgatatgctgatgaaagcacagtgttctgtttttgaatcttctcaaatgtccttgtctttgattcacaactttttgtcttaagaggccttcagcatcccatacaaggaaacaagtctttttttagctgctacctttggagttgattttgtttatgtctaggagcactaaattatttatacttatactattgaaatattcctctgttataaattcaaaaattgactttggaagataaaattttagttgaatttaatacatagcactctggaaagagtattggccacaacaaaaaaaaaggttccctactctattggataccaggtcatttaacagccatttacggtatgcattgtctttttgtttttatgatgaattgatatttcccaaatgtggaagagtgaatattactttgagatgtttgtgatagtccattccttgctcctcttcaaaattaatgtcattaaatttttattactttattagatcttcatttctcagataattttagttcattatagaaaggcaagaaaatacagatcagagtgacaactttgaaaatctcactctactcataaggggatgggtgtattttgctatatattacaaaattagttttcttgatgaggacatccactattggagtaatttcaggtatcttattttttcttttctctctctttttttttttttttttggagacggagtttcgctctgttgcccaggctggagtgcagtggcctgatctcggctcaccgcaacctctgcctcctgggttcaagcgattctcttgcctcagcctcccgagtagctggttactgaggcatgtgccaccatgcccggctaatttttgtatttttagtagagacggggtttcactatgttggccaggctggtcttgaactcctgaccttgtgatcctcctgccttggcctcccagagtgctgggattataggcgtgagccaccacgcctgggcaggtatcttatttcaaaacttacagtggtttagtgaattatacaattgcgtccagtgcgtagtatcctgaaaatagtattaagtcatgtgtttaggacatcaggtctcttaagctaagactatccaggcagaaattgccctcttctataaaagaagaaaagtattaattaggaagtactatcagtatggagaaaaccattttagaattattaattggcatggtttccttctttttttttttatttcgagatggagtctcactctatttcccaggctggagtgcagtggtgcgatctcggctcactgcaacctctgcctcctgggtttaagcgattctcctgcctcagcctcccgagtagctgggattataggcacataccaccatgccctgctaatttttttttttgtttgtattcttagtacagactgggtttcaccatgttggccaggccgcatggttttccttaataacaaaattaaggcatttattactgcatctagattttttttattttttattagagacttactcagattactcccaaagtaaaggaaggtatggtttaatcaatgcttcttaatgctgggttcacgtttagtcacctggggagtttttaaaaatgttctcacttctagggatcctggtttaattataattagcctgggtgaggctctggacagtcagggtgtgagctatgggtttcatgtgatgagatcccaggagtggctctgttctgtggccttgagaatttgtgctttctaggccaggtgcggtggctcactcctgtaatctcactttgggagaccaaggtgggcagatcatttgaggtcaggagttcgagaccagcctggccaacatgttgaaaccccgtctttactaaaaaagtaaaaaattagcgggacgtgatggcacatgtctataatcccagctacttggggagaggctgaggcagaagaatcgcttgaacccgggaggcagagattgcgagatcatgccactgcactccagcctgggcaacagaataaaaaaagaatttgtgctttattttcttgcctcacagtcccctttctgtctcagaattggcaactgcctgaaatagtctctgctgttatcatttgatagtacttttccacatcttgaatggatagatagagtgttttttataatagaagtggatgaatgattagagtatactaatatgacattgtattttcctaaaagatatgaattgatttcatttctgagcttttataattctcttctgtaatagtctgtcaaattattaaggttgataatattaactaaaatttgagtgcatattctatgtgccagactctgtgctaacagatttacctacatttgttcacataatcatcacaagttgtttctgtagtagatacagctattatccacgtcatagatgaggaaacaggcatatttaggaaacttgctaaagtgaggacacaaatctagcttttctactctaactcatgttcttaacattatactgcagtgacataaattatgtggtttggtttgttgtttatctcagttgtcataagtcgaattaatgtttgtttgtttgttttgagacagagtcttgctctgtcgcccaggctgggtacagtggcgtgatcttggcgcactgcaacctccacctcctgggttcaagcagttatcttgcttcagcctccctaataactgggattacaggcacgtaccaccacacccgggtaatttttgtatttttagtagagatggggttttaccatgttggccaggctgatttcaagctcctgaccttaggtgatccacccacctgggcctcccaaattgctgggattgtaggcatgaaccactgtgcccagccagtaagttccatggttgttaaaggatttctccacaaataaagctaaaagtaaaaaaaaaaaaaaaaaaaaaaaattctcaagcaatataagatgcagactattatgttgttcaagttttttttttttttttttaatctttggctttatttttggggaaaccttttttttcttttttgttttccttgggacggagttttgctcttgtcgcccaggctggagtgcaatggtgcaatcttcgctcactgcaacctccgccttctgggttcaagcgattctcctatctcagcctcccgagtagctgggattacaggcatgtgccaccatgcccggctaactttgtatttttagtagagactgggtttctccacgttggtcaggctggtcttgaactcctgacctcaggtgatccacctgcctaggcctcccaaagtgctgggatcacaagcgtgagccaccgcgcccagccagggaaacctttattttgaggcggagtctcgctctgtcacccaggctggagtgcagtggcgtgatctcagctcactgcaacctctgcttcctaggttcaagcaattcttctgcctaagcctcccgaggagctgggattataggcgtctgccaccatgcccagctaatttttatatttttagtagagacggggtttcaccatattggccaggctcttctcaaattcctgacctcatgatccacccaccttggcctcccaaagtgctaggattacaggcgtgagccaccacactcggctgctggggaaaccttttaacatgagtaaggtcagtgtgacttttaagttcttgatgctaacatcattgatttcaataaagtttaaaagttatattcatgcatatatgcaaatgaataaaaggctttgaaatagtgacttcttacggtacagtgaataagtttcctttggtctcttgaatgttatacatgttccagtttgatttactgagaaactgaaagtacctttacgtcatatgagctgtgagtcaccttggcacattcataattagaagagaccatcagattatcattggaaaatcagtttgtatttatcctttatttgaattccagtgcagacagatctgaggttctcttcattttgctaaaacttcttagggccttcagtcgcttttggctctgtattcgtgtatctttggaattgtcctgttatctctgcttgttttttacttgattttccatccatttccagtattcctttctcctctatttttttccttcattttctttctgctcttcctgttgcgccattattcatgttttcctctttactccaactcaactatggctttacttctgtttccttattccattgttcctcatactttttcctactgcttcattttctttgcagtattctcagcctagatgataggggtcagcaaatctgctcatcagtaaataaattttattgtagcatagctatgcccatgcgtttgtgcattgtctatggctgttttgatggctgtagccatagagttgagtagttgtagctgactgtaggacttgcaaagccagaaaatttgactgtctctttacagaaaagtttgccagctcttggcctaaatcatattttccgctgcatttagggctttttaggactgatcaaaaatacatgctatactggctttggtgaagtaacagaatgtgctctgtcctttaaacttacaactaattgcatgctttgattctaatactgtataatatcctgcgattcttattcatgaccattctaattggatttagtctgaagaattacttttgcttaacagattctttgtcacatttagtgaaaaatcataaaaggggaaggttggttaatggaaaagatctccatcaactaaccactaccttccttatctacaaatttatcttcttcctccgtgccatctttttttttttttttttcagatgatcttgctctgttgcccaggctggagtgcagtgatgcaatcacagctcactgcagcctcgacttcccaggctcaggtgatcctctcacctcaacctcctacataactgggactgtatgtgcacatcactatgcctgactaattttttatatttatattttttgtagagatggggtttccctgtattgcacaggctggtctcaaactgctgggcctaagagtcttcccaccttggcctcccaaagtcctgggattacatgagtcaccgcacccggcctcattattatttttcctctggttttagtagagaggatttttaagccaacttcaatcatgcccttgactctctcccttctacttacctccttgttctctttttctttttctttttttttagatggagtctcggtctgtcacccaggctgaagtgcagtggcgtgatttcagctcactgcagcctcagcctcctgagtagctggggctataggtgcctgccaccacgcccggctaatttttgtatttttagtagagatggggtttcaccatgttggccaggctggtctcgaactcctgacctcaagtgatcacctgcctcagcctcccaaagtgctgggattacaggcgtgagccaccacgcctggccatctttttttttctccttgctcttttataccacttctctgtttctgggctcttcaacatctgcctttctagttaatctttccctttagcatgaaaacctattcacttcctgctcatcctaaaaaggattcttttttgttttgttttgtttttgtttttgagacagagtctcgctcttgcccaggctggagtgcagtggcactatcttggctcactgcaagctccgcctcccgggttcacgccattctcctgcctcagcctcccgagtagctgggactacaggcacctgccaccacgcccagctaaatttttgtatttttagtagagatggggtttcaccgtgttagctaggatggtctcgatctcctgaccttgtgatccatctgcctcggcctcccaaagtgctgggattacaggcatgagccaccgcactgggcccaaaaggattctttttaatcctgaattcttctagccattatcctgcctaaggctacgattaacctctaactgccaggtcctttggaatctttttctgtctttattgctgcacttgaatgttggtttcaccctccttcagaatttcctcttctgtattttttatgtttattgatcattccttccctgcctcattcctgggcttcttttccttcacacaccccttagatgtgtgtccccagtgtttgtttctttgcctgctgctcttgccacatgacacacactgccagctaccacacacaagttccctcctatcatgtgtgtatcattgcccttataccatgttgtattaaaattatatgcttgtctcccctgttacagtttgagctctttgtgctccaagtaaagacagtgatactgtctttattatttattctcatggtctagtatagtgctttggcacatagtacaggctcaatataaatgtgtttgaataaatgaaattcagtgccttaatacacttttgtagaagcattattttatggaaagaatgaaaaagctgtaagtggtcttacatatatagtcatccagcagatacttagagagctctgggatgtgttccttgctgtgcttgttgctatggacagtacggagaaatacaagaatctattttgggtcccttttgagaacctagtgaaactgtgtacctagtgaaactgtataccctcaccctagaaaaatttacacacatgtagattttacatgtaattcttttaaaaattaattttttttcttttttttaaagaaacagggtcatgctctgtcactcaggctggaatgcagtggtgtgatcatggcttactgtagcctcgacctcctggctcaagcgactctcccacctcagcctcccaagtagctggggctacaggtgcacgccgctatgcccggctaatttttaaaaatattttatagacactggttctcactatgtttcccaggctggcctttacctcctgggttcaagcaatcctctaccttggccttcaaaagtgatgggattataggtgcaagccactgtgcccacgctaatgtaatttcatggtgttcacagtttcttcagggagttcatatacgccatgtactctattctaagcatttttagagttagagatagcaaagcacgtgaataaattcaagaaaaatggaatgttgtactgcatgacattgaatatcaaatggagtcagcgatgcaaataattgtctagattttacaaaaaaaattagcctggtgtgctggtgtgcgcctctaatcccagctactcgggaggctgagacaggagaatcatttgaacccagaaggtggaggttgcaatgagctgagatcgtaccactgcactccagcctgagtgacagagcgagactccatctcaaaaataaaaaataaaagaattgtgtagattttagtagttggaagaagttggagtgttaatgtgtaattagagaacagtgagaaataaaattctacagattgttttattctggtgtgctgttgtgttctcatatggttgtctttttggtcttgatagtgtatcagtaacagagtacgagtaacaaacagggatctcttctgaacggcgtgacattagaaaagctgtttacggcctcaactttgctgtggtttattaagacacagatatgtgttcattctggggccaagcagtaactggagagtggcacttattgaggccagtatggaggcagtacagagattattgagattaaaagaaagaaacaggtggaacggatctatgtaatggaaagctaaacagaatagttcgtggtacacagtagaaaagcattacatgtttattaagatatggtcatcttccatttattaaagttacatgttttataatttttagagtatatagaaattctctaccctatcatgtttgccaaagtcagaacaataacttcatttattaaatataaaaaaaataaaaacctctagcataaaatagaattttatttggacaaacgataaaaaaatactgtgtggtactagtaagagtaaggttgattcaagatacatgggagcagaatccaaagtgtagaaataggccaggtgcagtggctcatgcctgtaatttcaacacttttggaggctgaggcgggaggatgagttcaggagttcaagactcgccttggcaacttggcaaaaccccatctctacaaaaagtacaaaaattagccgggtgtggtggtgtactcctgtaaacccagctacttggtgggctgaggtgagaggttcacttgcagccagtaagtcaaggctgcagtgagctgtggttatgccacggcactccagctgggtgacaagcaagaccttgtctcaaaaacaaaccagccaggcgtggcggatcacctgaggtaaggagttggagaccagcctggccgacatggctctactaaaaatacaaaaattagctgggcgaggtgacgggcacctgtaatcccagctacttgggaggctgaggcaggagaatcgcttgaatccaggagacggagtttgcaatgagccgagatggtggtgctgcactccagcctgggtgacagagccagactctgtctcaaaaacaaaaataagcataggacatggggataaattgaagatttatgaagacacagctgaaggagacataaaagtagatttggctaaatggaaacatgccatactttgaatggaattatttaatactacaacgttgtcaattttcctcaaataaatctctaaagataatatattcagttttggccgggcacgttggctcacgcctgtaatcccagcactttggaaggctgaggtgggccgatcacttgaggacgggagtttgagaccagcctggccaacatggtgaaaccctgtctctactaaaaatacaaaaatcatctggacatggtggcaggtaccagctacttgggaagctgaggcaggagaattactcgaaccccgtaggtggaggttgcagtgagctgagattgcactccagccgggtgactccatctcaaaaaaaaaaaaatttttataatatatatatatatatccgtttttgtagaaattgacaaaatgattctaaagcttattagattatgtgtattaacagaagaactttggaaatttttttccacaagagtcataaaggaggacttgccctacaaaatatgtcagaattaaaacataacttgtcagctgggtgcggtggctcacgcctataattccagcactttgggaggctgaggcaggcagatcatgaccagcctgaccaacatggagaaaccccgtctctactaaaaatacaaaattagccggtcatggtggcgcatacctgtagtcccagctactcgggaggctgaggcaggagaatcgcttgaactcgggaggtggaggttgcagtgagccgagatcgcgccattgcactccagcctgggcaacaagagtaaaactctgtttcaaaaaaaaaaaaaaaaaaaaaagaattataactgtcacagtggctacgtatggagcatccaaaactgaatttatgtgggtattttattaatatgcaatatagcactttaattctggaggaaaggtggattattcagtaaatgattctgggacattggggacaaattagatacctacttcacactgataaataaaaccaaatagattaatgagaaaactgtgattaaacaaaacaacacccagactacactggagcaaatctgtgaatttgtttaattttgagtggagaaggactttataagcatgactaccagagcaaaaaaatcatgaagtaaaagatcgatacctttgattataaagagattaaagatttaggccgggtgtggtgctcacgcttgtaatcccagcactttgggaggccaaagcgggtggatcacttgaggtcaggagtttgagaccaacctggtcaacctggtgaaaccccatctctactaaaaatacaaaaaaattagtcaggcatggtagcacatgcctgtaatcccagctactcaggaggctaaggcaggagaattgcttgaatttgggaagtggaggttgcagtgagccgagattgtgccacatcactccagcttgggcgacagagtgactccatctcaaaaaaaaaaaaaaaaaagacttagacgtgtccaaaagtaccatacatttaaaaagacatgccacaaactgggaaaagtagaaaaatagttttaaaaatgaccagtgaatgtatgaaaaggtggccctcctcacttgtaatgatttaagaaatgcagtttatttttattttattgtatttttaaagaaattcagttttaaagcagtggaatatgattgtctatcagcttgcgctgaatggtaaatgtgagaaagattactactacttagtggtactgagggagttgcaaaacacttaacactgctagtgggatggtttaagtaaaacaagtagcattcttaaactctctattaggtaaagaataggtaagtaatgcatatgtttccaggacattttcagtaagactgtttactgatagggttgtgtaatgctaatatacttactatctagttttagtattatttttttctcttgtcttggatggtttcaatggagtcttatgcatgcagatatattaaaactagtaataaagcaagagaaggaatgtggataaattatctctaatttctattttgttctatttctatttcatactcctgggaaagaatattaagtgggcatgtgtacttgaacagttgttctgttttttattagaaaagaatccgaatctataaaatgttttacatatttgccagggaaacagaaaagatatttgtacagctgtaagaattggaattaatttcattttactgacttttccttaacctaattctgaacacttttgccataggtttgagaataagttgttataaaatgactactattcttcactaatagtattggcatttcaattcctaaattctgttttttgattcttgaacatttctgaatttactttttttgtcttagttcttctacagaatcattttcttcttttttctttttttatttttattttttatttttgagacagagtcttgctctgttgcccaggctggagtgcagtagcgcgatctcggctcactgcaagctccgcctcccgggttcatgccattttctcctgcctcagcctcccgggtagctgggactagaggtacccgccacagcgcccggctaattttttgtatttttagtagagacggggtttcaccgtgttagccaaggtggtctcaatctcctgacctcgtgatccatccgcctcggcctcccaaagtgctgggattacaggcatgagccatcgcacccggccttctttttttctttctctttaacttctgagctgaaaatagtaccttttataaagaagtgctcaaacgatgattggactgatttctccttatttctctctttctctctgtctctttcactctctttttagaatttttcttttttaagtagagacgaggtcccactatgttgcccaggctgtcttgaactcctgagcccaagcaatcctctttgcctcagcctcccaaagtgctcggattacaggcttaagctatcacaccaggcctaggctaatttcatattttgagatggcacaaatttctttcaggtagctagcttttcctcctcctccccacttaaaatagatcctgatccagaagcctaatggagaaaatgaaaacagaatgttcacccataaacagtatctttgtattggaatcttttctaaaacttcttttgatctttttaggagatagtgtgggaatcagcaatctagtattacgtacgtggaatctgtcaccttgtttttttaaatacagcaaacctcatgaagtgaatttccatattttttcttgttcttgttagttttgcaccactcaggctttgctgtagaatttgatgtatatttgattctgtagagcatgggctattgatcttcactcagctttcagaggaatctgattagtaagtttgagttttttattattttttagttgattttgaagtaaaatacagcaccattttaactgataccatttctaaacaattttcagttcaaattttaagttagctaatttagagcttaagaaaattgctttaaaaacataaaattactggctgggtacagtggctcattcctgtaatctcagcactttgggaggccaaggcagatgaattgcttgagcccagtagttcaagaccagcctgggcaatatggtggaaccccgtttctacaaaaaaaatacaaaaagtagccagacacggtggtatgtacctgtagtcccagctattcgggtggcagaggtgagaggatcatctgagcgcagggagattgaggctgcagtgagccaagtgagaccctggtttcaaaaaaaaaaaggttactaattgcagtgccttttatcttatttaatgggcttagtcaaactaagatgatgtattttatcttataaatgttttcccttgaattttaactgaagaatccaatttgtacctctcacaaacagaatgtattagtaaggaaaataaatactgctttttattacttaaataggatatatttttctcttagggattttttttctattttatctcactttatcgtagtgctagaaaatttaatcattcatttgagatagggagaaaattaggtttttttttttcttctattttgagacagggtctcattttgttgtccaggctggagtgcagtggcgccatcgtagctcaccataacctcaaactcatgggttcaggtgattcaccttagcctcctgattaagctgggactgcagatgtgtatcaccactcctggctaatttttgttgttattttttgtttgatgaggtctcattatgttgcccaggctggtctcaaactctgggcctcaaatgatcctcctgccccagcctcccaaagtgctgggattacaggcatgaacctctgctcccagcccattttttaaaatatattcacagcattgtgcaaccatcactacaatcaatttacattttcatcaccctgaaaagaaactctgaaccccttagcagttcctctctgtttgtttcaattttccccagctccaggcaactattgatttattgtcttcataggtttgcccattctggacattgcgtattaatggaatcatataatatatagcctttttttttcttttttttttttgaaacagagtctcactgtgtcgcccaggctggagcgcagtggcatgattgcagctcactgcatcctctgcctcccaggttgaagcgattctcctgcctcagcctcttgagtagctgggactataggcgcctgccaccacacctactaattttatatttttagtaaagacggggttgcaccatgttggccaggctggtctcgaattcctgacctcaagtgatctgcccacctcggactcccaaagtgctgggattgcagccatgagccaccgcatctggccatatatattatgataggcttgtttcacttagtatgtttcttccatgctgtagcatgtattagtacttctttctttttcatggccaaatattccattatacagttacacaggtacactacattttgtttattcatcagttggtggacattttcattgtttccaccttttgatttatacataatcctgctgcgaacagtgacttttaaagtttttgtgtgggccgggtgtggtggctcatgcctctgtaatcccagcactttgggaggctggggctggcagatcatttgaggccgggagttcgagaccagcctgcccaacatggtgaaaccctgtctctactaaaaatacaaaaatgagctgggtgtggtggcgtgcacctgtaatctcagctactagggaggctgaggcagagaatcacttgaagctgggaagccgaggctacagtgagccgagatcacgccactgcactccagcctgggtgacagagtgaaacttcatctcaaaaaaaaaaaaaaaaaaaaaaaactgcgtgtggacataggttttcaattctcatgggggtgtgtgtgtatgcatactcatacatacatacacatacctgcaagataattgctggctcgtatgctaaatctatgttgaaccttttacataactgttgggctgttttgttttctttttattattttttgaaaatagagttggggtctcactgttgcacaggctgatttcctgggcatagtggctgtatcattttacaatcctacatagctgtttccaacgtagctgtatcattttacaatcctactagcagtgtctgaggtttcttatgtttttcacatcctcaccagcatttgttattgtctgtctctttgattatacccatcctagtgggagagtaagaagtagtatctcactgtagattttttttttctgtttacaactttactttaaaaattatatatgcacacatggtaaaaagttcaaaacgtgtgtaccaaaagatttaacagtgaaaatagaaaataagtgtggtccttgttttcttccaccaaggcaaatattgttataatctcctaaacaacttgtcttccagatttctcattttcagtcaatcttgggcattgacataaagaaattcttagacattgcttttattagatcatctcatcccttgctcaaaatcttcagtggccactgttgtttacagaataaagttgggatgctatacagggcccttcccagtggaacttctctttttcaaccttatctctcattatttcccaatgtttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccacctcggcctcccaaagtgctgggattacaggcgtgagccaccgcgcccggcctatttcccaatgttaatctacttattgacctactaagctggcatgttctgtgtgttagacatcaccaactttgtgccttctttttttgtttgtttttgagttggagtctcactctgttgcccaggttggagtgcagtggcgcgatcttggctcaccacaacctctgcctcccgggttccagtgattctcctgcctgagcctcccgagaagctgagacgacaggcgcgcgccaccatgccctgctaacttttgtatttttagtagagatgggtttcactgtgtttcccaggctggtctcgaactcctgaccttgtgatccacctgccttgggctcccaaattgctgggattacaggcgtgagccaccgcggccccctgtgccttcttcttttactcctggatttaatcccaacgtgaagaatctaccttactaactagagttttagatactttttcaaaaccaagcccacatctgtcctttttagagtcttctctgaccttccctgctcattgtggtttgtttttattgcctgtaacaatggctgttaaactttacattttaaattaatttatgtttgtatgtatttatttgttgagaaagggtctctctctgtcacccctactagaatgcagtggcgccatcatggcttactgcttcctgggctcaagctgttctcccatttcagcctccccatgcaccaccctacctggctaatttttttgtttgttttttttagtttagtttttgtagagacagatgtctcactgtgttgcacaggctgatcttgaactcctgggctcacttgatcctcccatctcagcctccccaagtgctgggattacaggtgtgagtcaccatgcccagactttaacattttctttttagtatagaataggtcagtttttttccctctgatgagatcccatgctgactcttagttaaaacaaggctttggttggaagaagagctagtgatgtcctagctccctacttactccactttcccttgccttctggggtgtcctgaagacatcatagggtgtcatgaagtacagttggagaaccagtggtctccatcatgtaccaaacactcatcttcacgaagcagtatgtagtgtcttttttaccggtatattttctctctcccaatgcattaaacttttctggagttcagaaaacaaatttatagaattaaggaaatgcgtcccccccaaccatggtgtctagtatatatacagtgacttacagataacaggtgttcaacatatatatattcctttgattgatttttgaaaagtttacatgtatatattttttatatacggggtctcactctatcactgaggttggagtgtggtgatgcagatcttggctcaccgcaacctcctcctcccaggctcaagtgattctcccacctcagcctcccgagtacctgggaccacaggtgcgcatcaccatgcctggctaattttttatatttttggtagagacaggattttgccgtgttgcccaggttggtttcgaactcctgagctcaggcagtccacctgccttggcttcccaagtgtgagccaccactgaaatacttatatttttaaacttaatttatttatatttattatatttttatgtttttatattttaaaaaatatttttatactcactagacccaattttatactcctaaaccagggaataactgtttttttttctcttacataggcatgataccatagacaatgattaaaattgtaattaccattcatttcttagttttgtggctgggacactgatgtcttcaaatgttagtttgcaaatacagtcagccctctctatccatgggttacacagctgtgaattcaaccaaccatggatccaaaatatatgggaaatacgctggggctgtgggtcacacctgtaattccagcacttagggaggctgaggcagatggatcacctgaggtcaggagttcaagaccagcctggccaacatggcaaaaccctagctctactataagtacaaaaaattagctggccatggtagtgcacatgtgtaatcccagctactcgagaggttgagacaagcaatttgcttgaacctgagaagtagaggtttccatgagctgagattgtgtcactgcactccagcctgcgcaacagagtgtgagaagaaaagaaaaaaaactgtctgaaaagaaaaaaaaaaattatatgggaaatcaaaagcatctatactgaacatgtacagactttttttcttgtcattattccttaagcagtaccacaactatttccgtagcatttactttgtattaggtattataggtaacctagaggtttaaagtatgcgagagtatgcaaatactacaccactttgtatcagggacttaagcatccctggattttggtatccctagggggtattagaaccaatcccccatagatgctgaaggacaactgtagtgtgtgttggaataatttattttcaaatggatcatttggagaacactattctttaggaaacatagcctcctaagttctgttccatacatccctttcacctccacggcgttgtagcatcctgctttcatgactgtgtcatcactcggaaggaactgcttctcttccagaatgcttttcaagatctactctgaccacagctataaactttacacttctattctcttcttgcccctcacagtgttctctgttcctctaagatcttaaactctgtctactcctaatccagcctgctgggtgtggctggagaaagtcccactggggggctgattagttaggaatgtagggtttccagctcttgctggagcctcagaagagttcagcagacttttttttttttttttttccttaaacctatttctgcagccttgatgaccactccttccagtccctcacctatttgctttattcatggcagaggctctttcttcctgcttgtcagtacaaagaggcaggattcttcacctggatctgtggattctcaaagaatttgtggagagaattcagggcattgatgaccttggatgaagagaaatttacatctttatttacactaaccttcaagtgaaatttagcattttttgccatttaaaaatatgggcaacaaacaactagtagtattagcagtatttatgacttaagcacctatagaactcagttaatttcatatcgcttgatgttatgggtatctcaaattattattttatgtatatatatttttgagatggagtctcgctctgtctcccaggctgagtgcagtggtgcagtctcagcccattgcaacctctgcctcctgggttcaaacgattctcctgcctcagcctcctgagtagctgggattacaggcgcacaccaccacgcctagctaatgtttgtattttcagtagagaaggggtttcaccatattggccaggctggtcaccaactcctgacctcaagtgatccgcctgccttggcttccaaagtgctgggattacaggtgtgagccaccgcacccggcctcaaattatttttagaaacagaatcttgatatggtatccgctctggccttgaacttgtgggctcaggcagtcctcccacctcagcctcctgagtagctgggattataggcatgtgccactgcaccaggcttcaaattattatgtatgttcatcacctctttaaatttataatagttattaaacctgttactggatcttaatatttaatgctttaattaagaacatgtatgttactatgccaacagatttttttagtttttgataactgcatttcattgttacttgttctcatttgatttcctgtgtattttacgaatttaagtacattctgaatacggtttcataggcttccctaaaatattgaaggggcccatggattaagaaaaaggctaagaatccctaatctagaggctccccacagtcctcttttgtcatcatacccctaccccattctagcctgaggagcgtggctccacctgtgcccttggttttgttgttccagtccatacatcctgcacccttaactgtgtttcttatccccaacttgtttctttgtgttattcttcagtattatagtctttaatataatctgtataatacatggtgtagtagtatatgctcgtagtatacaattcagttagaacagatgagtattcaatgaaaagataatctcctctctaacccccagtcccacttccctggggaagcctgtgttcttgtgtacaattcagaaaatgtttatacacatattttttatttatttattttttgagacggagtctcgctctcgccaggttggagtgcagtggcgcaatcttggctcactacaacctccgcctccctagtagttcaagcaattcaaggttcaagcaattcgcctgcctcagcctcccgagtagctgggactataggcgtgtaccaccacgcctacctaatttttgtatttttagtagagacagggtttcaccatgttggccaggatggtctcgatctcttgacctcatgatccacccgcctcagcctcccaaagtgctgggattacagatgtgagccactgtgcccagcctgttgatttaattttaaacagagtttcgctcttgttacccaggctggagtgcaatggtgcgatctcggctcaccgcagcctctgcctcccaggttcaagtgattctcctgcttcagcctcccgagcagctgggattacaggcatgcaccaccatgcacagctatatttagtagagatgggggtttctccatgttggtcaggctggtctcgaactccggacctcaggtgatccgcccgcctcggcctcccaaagtgatgggattacaggcgtcagccactgcaccccgcctatacacatttttttgttttttgtttttttgagatggagtctcgctctgttgtccaggctggagtgcagtggcgcgatctctgctcactgcaagctctgcctccctggttcacaccattctcctgcctcagcctcccgagtagctgggattacaggcgccggccactacgcccatctaactttttgtatttttagtagagatggggtttcaccgtgttaaccaggatggtcttgatctcctgacctcgtgatctgcctgactgggcctcccaaaatgctgagattacaggcgtgagccaccgctcccagctatacacgtatttttaatgccactccagtctatgttggaaccattttacttcccctttcttattttcttcttgtgttcttgaaggcctagatcagctgttgctgataggctgtcactgtcactttagaaagcccagagccttttgttccttagaactttgtttttaattgtattgtagcactcattgtattcgattctaaaagatttgcttcatttctgtaactagtctcttacacccaggagctcctagttcctacaggaaatgctgggaattgtatcagtcaaatgtgaatccccacctcgtccagacttatgagtgcattgtaggtactcagtaagtgctaaaaatgactaaatagtcccactgataccaatctatatactgatactttatatagtatatagattggtccacatataacgatgacacataatgagaaactgtcttaaaaagttgttgaaagtgccgcaggaataggaattgatcaaaacaatatgattttttaggtttatatggaactttgatgtttgagaaaaggctgatttagttgagaagaaatggttagctgaggattttgatgacttctctggaagcacatttgagggtttgtgatgttaaatctgatgttaatgattatttcatccagttttatgtcattttatagtttttatacatttaagtatatttatttctaatgtttaacactaccattttagttatttgaccattattctggccctttaaaaaatgctcagacaagtttgaatgatttttcagaggcattattggctcagaggtaaaagaggaaagattgagaagctgaatatgtactctgtttcctgggtatggggctggggatacccagaagaggttcacacgttggtcgagacatttctttatgaccaccagcaggtggcatcaccggcccaaaatgactaagtttctgcccagaatcagaagagaaggtgttgagagcccactgctgtgggggtagcatggaggtgggatacaggggctggaggtgatacaattttgtttcttcctccaacatcgcctgctagtctagaggcttttataaattgaaaaactaattctttatcatctcatctgatggtttttatgtttttccttttttctctctatacctgtagttccttcagaaacaggtaacacttttctaatagtcacgttgtattcttgcatcttgttgttacaatgcttttgtttctcaccataggggatgatggaaaattaatattctttgacttatggcattggtaaaatctgcatgcaaattcccacagttgcctgtagattagagccagttgtttttttctcaactttgcaggaatcctggttacaacattgtactatttactaccaacagtgttttttttttttaaaatccagacttgctgggcatagtggctcatgcctgtaatctcagcgacttgggaggctgaggtgggaggattgcttgagcccagggctgcagtgattgcggcactacactccagcatgagtgacaaagaccccatctctgaaaaaacaaaaacaaaaacaaattttttttaaagaaacagaaacaaaaatccaaacttgtaaccactgtaaaacaaatcagaatttacgatagtggatattattaatagtgcagaatggatacccagatcttgcttcctttctagctaatgatgcaatgttggcctgaaatgcattacttatagccagggattttctcagcatcctgatgatatagcctcatttcgtgctaactctccacttctgcacatcttcccctaagtcctttactcatctttagaaagagctacttttggtgaaattttaaaaccaaggaatatcattctttatagaatcacacttctgtgttttccccttccccatttctgtctcgaaagcgacagactgctacataacctgtgaatacttttttttaaaaaaagtttggtattgtaaacagaagatttaagattaaaatgtagcattgagaaaaatagatttattaataatgccctcttaacacaacctaaattctggtcagtggaataaagcctgggtcctaaagttttagacgcttgcttgcttttccacactggctcttacttggggatccttttagaaatttgtttagaataatactgtaaaaacatatttaagctactttgtgtgtacatttgggatcttttggtttgaagacggcttgactcaagactttctaaatattttcacacacacacacataccctgtagtgagaaaaaaatccgtttatatggttctataaaaatctctagctgcttcgagctttaatttcttgaatcaaaagagtattgtttttaatactgagcttctatctaaataaatgctttatttacttaaatgtgtgcttttcaaaaactagtatgattaagacattaacaggatcttagacgtaaaggaacagtcctgttgcttcttccagaagataatatgactcgtttggaattttcctatagtgtagttttttgtctagtgttgtgagaattaaagggatttcaggatcttaaggtaggttattatttgatgttttcttggaacattttacattcttgaaaatacacatggctaaattaatttttgccagcaatccacataactttaagataatgtagagaagaacgtgattcaggttagtatcaaataaggtcagatttctagtgccatcagtagctttcagcaaagatgaggtgttggtaagatagcattagtctcttagaatctcttagagagattttccaaaattcagccatttctagtgaatgctccattccacccccagctgagtcctgctgctctggggaactccctcagcacactcttggctcttagaattgctagcaatgggagtagtgctgctggtggagctggcagctaagcccagaggtggattaatgcttttattccctgatgtacaggtacacacactcatacctacccacacctagtttgggataagaagaggttagaattagctaggcttgaagttccatgcttaaatttgctggctcagatttcttattttggcatcactttgcccattagggagacaatgacagttatagaagcattgccaaataaaaaatccatctggaataacctcttttgtaggagtattgtgtgtttagttgttgattcgtcccttcctcctcttagtggcaacttacagtactgggaaggaacagtggctgggagcttatattcctcagcagagccagatcagcagaagtattactccttagttcgtagtaggtggtaccctatgggtccagtcatttaaatgcaagcctgtatctacagagcgtttcctagtgccatcattgcccagtgggcctttatttagctgagtctaactcccaactagagaaaatttcctgtgccagacagcagtatggtcagctaacatgtggatgctacatttgctttcataagtcagtactcttcaataacattagtagaagagaagaggacacaaagtgagagtgtgttaataggaagtccaggtatgcctgctacctgaactttctgagacaggtaatactgtagggcctgaactttgtagcagagtggttatatatgaagaagtgggttctgggaggggttaaaccacttagaatggcttcatttactaatggcaagagtttgctgggatattgaccactgtacatagacatgaatatggaaagttaaaaacaaaatccacatatatttggctgcaagtactccgaaggtatatctaattagtgcatccattaaacaaaagagatattttaggccgggcatggttgctcacacctgtaatcccagcactttgggaggccaaggtgggtggatcacctgaggtcaggagttcgagaccagcctggccaacatggtgaaaccctgtctctgctaaaaatacaaacattagctgggcgtgttggtgggcgcctgtaatcttagctacttgggaggctgaggcaggagattcccttgaacctggaaggtggatgttgcagggagccgagatggtgtcactgcactccggtctgggtgaaagagcaagctccatctcaaaaaagaaaaaaaaaaaaagagatatttttgatggattgatagaaattttctttttctttttttttttgagacagggtctcactctgtcgccaggctggagcacagtggcgtgatctccattcattgcaacctccacctcccgggttcaaacgattctccttcctcagcctcccgagtagctgggactacaggcatgtgccaccatgcccaactaatttttgtatttttagtagagagagggtttcaccatgttggccaggatggtctcgatctcttaacctcatgatccacctgcctgggcctcccaaagtgctggtattacaggcatgagccaccacatctggccagaaattttcttggtcacttctgagacatgcagagtaattacctgtaatataatttaatgaattatgtcaatatattaaaatatgcttcatgtgggctgggcatggtggctcatgcctgtaatcccagcactttgggaggccaaggtgggggtatcactaggtcaggagatcaagaccagcctggctaacacggtgaaaccccgtctactaaaaatacaaaaaattatccgggcgtggtggtacacacctgtagtcccagctactcgggagactgaggcaggagaatcgcttgaacccgggaggcagaggttgcagtgagccgagatcacgccactgcattccagcctgggcaacagaacgagactctatctcaaaaaaaaaaaaaaaatgcttcgtgtggcttaaaattatatgaaaagaaaatacctttactgatagtcatctgtgattccatttgctaaattaaacgtgaaagcatacttttactgaatactatatattccgtatcagtttagatagcagtttatcttcacatacataagttttaagtttacctttattatagtgcattggtcttttgttttcatcaacctaaattatgttcaataaatgtttctgttagattttaagttaaacaattatgtgaaattcatttttcgtaattgttttttaacatatgtctttgttggtaattcacgtgtgtgagtgtaactgattgccagattatataaactttcaaccaaaaccattctttgcagatgcttttactgactctgctatcagtgctaaagtgaatggcgaacacaaagagaaggacctggagccctgggatgcaggtgaactcacagccaatgaggaacttgaggctttggaaaatgacgtagtaagtaacatctttgtaattattgctagactctggtcagtatgacatcctgtcacttggttgtaatttaaatgtgcttttgttgttgttgttattgtagtgagtgtatttagagcagcaggtttgttgtataactagagactttctcccaagcaatatataaagaaaaatgtttgtcattttacttgtaggggttaagcaggagtactgtctgttcttgtggatgctcatgaattacttctttgtgattaaaataaataataagaagtagcttaaattaaaattagaaaccatgggaaatgccggtgtgttttgctttaacacccagccaaataaggtagcctaaggaaagtggtgtcttaattgttgacttcacctagagaagaggttgaagtaggacattttaagcctcttgtctgaagaaaaggttgtcattaagataaataattaggttacattggaattaaagcattacataaatttcttggtcttaaatttggattattctccacaaaattcttttatttctaaaacgcctcttgtcacatactagttttgtttctctctttaatgcattatctgtacttgaagtgcttagctgggtatgctggcacatgcctgcagtcccagctacttgggaggctgaagcaggaggatcacttgagcccaggagttggagtccagcctgaatgacataaggagaccccttctctaagaaataaaaataaaaacaaatacttaataaagactctgtctttaggatagagagcatagagatataaagcaaagtgtcttgccaaaaatgagtgttatggtaccaatatttgagtagaatgaagaatcttccattgagtagaaagagaatttgtaacatatctgtgtttgatgtttaaggcataacagcttaataatgacactcttcctcagacaggaagcctgaaatgtcctactttgacctaaagtctagtaataaaactggacatacacaggcaacatgtcattaattctcaaactttaacaaatcatatataacctaatataatggttctcaagtctgtacatcacgtcacctgtatgaaaaatatgaggaaacagagacttcttttacactattggtgaggtggataaattgatagagtctttctggagagaatctggcaatgctaatcaaaatttaaaatgcacatacactttgttccagcagttctatctctagtaatttatttttgccctcatatatccataagacatgcaaataattatatgtgaagattttttttttttctttttctgcagagacagggttttaccatgttgcccagggtgatctggaactcctgagctcaggtaatccacccacctcagcctcccaaagtgctgggattacaggtgtgagccatcatgcctgaccaggatttttttttttttcagcattatttcttttgttgttgttgctgttgttttgagagatggagtctcactctgtcacccagactggagtgcagtggtgcgatctcggctccctgtaacctccacctcctgggttcaagtgattctactgcctcagctttccaagcagctgggactataggcgtgcgccaccacacccagctaatttttgtatttttagtagagacggggtttcaccatatgttggccaggctggtcttgaactcctgacctcaggtgatctgcccacctcggcctcccaaagtgctgagattataggcgtgaaccaccatgcctggccatagcattatttctaatagtgaaaaattggaaacatgctaagtgtctatcaatatagcatgagttagatttatgatgtcaccattcaattgaaacactacatatctcccaaaaagaatggtgttccaatatggaaagatatctaagatttattaagagaaaaagcacattgcagaacactgggatcctatttgcttttttttttctttttttgagacagagtcttgctctgtcacactgcaacctccgcctcccgggttcaagcgattctcctgcctcagcctcctgagtagctgccaccatgcccagctaatttttgtgtttttagtagagaaggggtttcaccatgtttgtcaggctggtcttgaactcctgaactcgtgatccacctgcctcagcctcccaaagtgctgcgattactggcatgagccaccgcacctggccatgaaatttttttttttttttaaagagctgttcatattcttattgcctagaagatgtctgaaattacacccaagaaactctttttgagacggagtcttgctctgttgtccaggctggagtgcaatggcgtgatcttggctcactgaaacctctgccttccaggttcaagcgattctcctgcttcagccttctgagtagctgggactacaagcgcccgccaccacatctggctaattttttgtatttttagtagagacagggtttcaacatgttggccaggctggtcccgaactcctaatctcaggtgatccacccaccttggcctctcaaagtgctgggattacaggcatgagccactgcgcccggctgaaactctttttttttcttttaagatggagtctcgctctgtcgcccagacttgagtgcagtggtgtgatctcagctcactgcaagctctgcctcccgggttcacaccattctcctgccctagcctcccaagtagctgggactacaggctcccgccaccacacctggctaattttttgtatttttagtagagacagggtttcaccatgttagccagcatggtctcaatctcctgacttcgtgatcctcctgcctcggcctcccaaagtgctgggataccaggcatgagccaccgtgcccggccagaactcttaatagtagttatttatgcacgctgggattggaagacatttactttttactggatgtctttccgtattgtgtgcttttttttttttttttttatgtagggcatacattacttaagtaattttaaagcctccataagtaagtgtgatttcctgcccatgtgtttggcaaaaggaattgcattggtggtagacttacattatagtcttacctggagtagcacaggaggacccaaggttaataggtgaacttcgaggcaagccttagcattgaggttgccatcagcattgcttggttgatgtgttcattcttctgggatggattacaacctttactggactttatacttttcaccagtaaggctttaaaaaaggagttgaaacattagagaataattatccaggcagtaatattcactggtaaatagtcttccagcctgtggcccaattggttgattcttttacgttaaagaatgcagcctcagctgctctgcctatggagtaggattcttttatttactttcttaataaacttgcttgcccctggctcccccccaccaaaaaaagaaggcagcctcccttttgcgaatggtaatttcctatagtttcctcgtagaattgtggagttacctatgctgaggttataggttagggtattgagatccagagttgccacttctgaggtgtcacaactgctaatggtaaaaccatttctaaagcccagttcttgtgactttgtccagtgattgcctgttcaccgtttcatgctgccttcccatttgagcattcccaggaggaaggggaggttgccagggacctagtaccatagtccgaccttggaatcgttgaatatgagggaaagcgttggcttctcccttctttctcccaaacattggaagtatttttggctgttaaaaagcaccccttgttccatgtggaatcccttgtttaaaagaagtaaaatatgtacctcctgtcctccacagacctgaggaccagtgtgatctcaagaaggttacaggtaaatgtagatgtctctaactgaaaggtggcttttacaggttagagaaaagagagaaccctgatctgaaggctattttatgaagtaattaaaatgttctaaactttaaaaataactgctcaaataattgtgttgtatagttacttatcaactggaggggctgataagtatttttctaaaacatttttaaggaaattttttcctattttctaatttgctaattttgctcaagtagtttgttagatattgttaatatagatgttggttataactgaatgaaagggaacaactactttgacattttgaaaaacaagcttcattttcttctagtctaatggatgggatcccaatgatatgtttcgatataatgaagaaaattatggtgtagtgtctacgtatgatagcagtttatcttcgtatacgtaagtttgaaaagtttgtttttattttagtgcatttgtctttgattttcatcagcttaatttatgatgaataaatgtttgttagtttttaagttaaacaattacatgaaataatttttctcttattaccaactgtgataaatttccattaaaaaaagggaataaatgtagtttgcctataccctgtttttatgctctaaacaaattttggttttgtctttttttttcttttgagagggaatctcgctgtgtctccaggctggagtgcagtggtgcaatctcggctcactgcaacctctgcatcccgggttcaagcgattctcctgcctcagcctcccgagtagctgggactataggcgcgtgctaccatgcccatctaatttctgtatttttagtagagacggggtttcaccatgttggccaggatagtctcgatctcttcacctcgtgatccacctgcctcggcctcccaaagtgctgggattacaggtgtgagccactgtgcctggccggttttgtcttctaagttgttaaaaaatatctaaatttgcaagggcagagattatggtgaacagtttaaccagtttttgaaatatgttcctctggagaaaaggtaacagaaaaaaaagttagaattttgatttataaatacacagatcactataacttttagttttagttttagttttagtttctgtttttaccagtattctaaactctaaactttcttagtagttgattatgacagatacataaactgtggctttaaaggactcattttgcttttcttttcctcatgtttcagagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactaggtatttaaaggaaatcatgatgcagtattttggatacacaactcaaggtctgtgtgagacggtgtattgttattatatttcctcttcctttaatatagcttaggtagagaatgcaagtagaattggtttaagatctgttagagaaaaggttatggtgatcttggaaaatatgcttttgagagtaagctctgtggagccaagtgttggtatatcacggtgagcaatccaagatcttgaagagcttgttaaaatagttatctggtgggggacacgtgtaacaatcacagcagtacaatatgatttgcttggttaaaggcatgttcaaagtactaggaacatacagaatgaggaggagctagcataacctgtagagtcagagaaaacctcattgaggaggtgacattttgtgataagataatagggtctttgacacttagagaagagttgggagaagagtttatcacctgatgaaaagccatgtacaagcatggctatgagaaaatttggccagctcaggagagggctggttgttgcatgtgtctggaacacaggatctgtgtcaggtgcagcagtggcagttgatagtaggaactgaggtcattaaaggacttggcatgtcatgctaaagagcaccctgttggaaggagatggggtgaataaaccctggggcattgaggactggctgagacacagagaacagttagtgcactgaaatagttcaactgtgagaatttggtaaccacctagttaagggatgagcctgaggtttatttgataactaagtgacttaatggatgtactggtaagagagagaggaaacatggagcaagtttgaggggaaaaacagtgactccgtttgtgcagctaattgcatatgtgggcttgtgggtctttcatttattcataaacgtgttgagaaatacctgctacctatctagtaaagtaagagatgcatcctctcttaaaggcagtcagcttagagtctggtgatttgaattgacatgtccactgatagatgttgacactgtgagactggcggttcagtttgaggtttcatcagcattgccgatattggagccatgaaaaaccaaagaacagccagtgagagaagagatctcagagaaaataaaattgagaaagtgaaggacaaaaaatgttgtgaagatagaccaagattgatggaatcagccatagagaggtcaagtgggatgagaatgagcacgcatctgttaaactttgtgcttaggagcagaatctaagggaagggacagtccagaggttagaactcagggtaagatggaagaacaggggcatctgggagtgaggcagtttggtttagtgtagaacctttttgtaacaagcattcccttctgtctagatgacttttagatatgtttcattggcttggtaccttttagaataaaatgatttagaggatctctcattttcagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggcaagtattttgaccagacttgtcaatatcattgataaaatagttttctaaatacttaaaatacttaaaatagtttacataactgatatgaatgtgcactttaatgatttggtgagtagctttcacttcagcattacttaaaattggcttttgtggatattaaattagtaaaacattgtatatgtcattgacatatatattatttagcatgatgaaatattcatgatgtactaagataaagtgctacatttaacccaagacaatcacttggccaaaaacacttcacatataaagaaattggaaactttgggtaggttctcaattttaaaaacactggataataaaattttttagacataatttatatggaaaattctaacctatgtgcaacactgtggttaatatagatcaattttcattatttgtttctatattatgcttacttcaagaaaggatctgaggtaacttataatacaagacatgatcaagagtcatgtgaagaaagtgactagagaaatttgcttaaaaaacaacaaaaacaacccttagtctaagggtggatgttacagtttagcaacttaagtaaaagaaacctgaatctttagtaggaagacattttttactctacctctaaatctaggttgaatatatcttgtaggttgtggatcttttccataaatcagggatactgaacaacagttctatggatggtatggaaatagtaatagcaatagtatgttactaactttgtgggaaaagagtggacattcaattttagctatttaaatttggaaagttagatgaaaatagagaacactaagtttccaatttcatttgttttcattgagtcttttctccagaattcctctccaaatggacactcttgagtattttcagtacttaatattgggggtgaaatttctttgctcactgaggaaagattttagttgtttataaacagaattttaaagttaaaaaacctgaagggggctgagaaatatatgatacttaagtgtgtggaaccctatggagaggagacctggactgtttgataagattaaggtaagtgatatgtaatgttaaatactagctgtatctttacctaggcatatccatcagtataaatttatttggtgatgactgctttgtagttgcagtatttattaagcagtcgcttagataagtgtttaactgtataaattatttagaaggtctccctttttctagtttaatgaggtcaagactttttttttgaaatagcaatgaatattatcatttgatactcacaggagtcacaaactctagaagagtaatgttttatttctacttaaatgggacttgcttaataagattccaaactgagttctgggttcaagtgtaaacctgatgaaaatcatagataattgtaaggaaccagcatttctaattggatataatagctactgcttattttcgttatgcctcagagttaaaactaatacagtaaataatcttactcctgagtaggaattattgtgatttattatgtgaaattatctagtgtatgttatattcctttaaacaaccagttactgagaaacagttatagaagcaggattaataggcaaagtcttaactgtcttcttcaatagtgtgtatagatcctaattaaccctttgggaacgtgtattcatttaaacagacttaatcttaaggaggttaaagtaaaatgtgaatttatgtcagttaagttatgctaaaacttatcacaaatcaaatgactgtcctcaaagggttaaaatgtacaagaaatcatttttgtcattttactttttttctgtttacttttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaaggtacaataccacaatttgttcatgtttttgtttgtctttgtttaactcctatgtgagtttataattacaaaatagtttcctcttcattatttaataacctataatttctgtgttttaactttagtttattaaaactatttctattaaccttttgttcattagagagaaatttgataaatgtgtgaagctataaactctcttgaattgttgttaaaaagggggtttatctctgcctgataattatgcttctttacagccccagaagggtctgccccacagccttccccctccttatttgcactgtatacagtagttaaacaaatgaactttcttcagccagtcttgaacttaggttcattttacagctctttggccaaggtcctagtgaaccttcctattggccataagcagggatggtgttttctgggtcttttttgagagcgacagcccatgtagctgactttgcgtgtctgcccttagattaaagtagttgatttttagaatgccagaagaattctaaatttaactgagtaatttttttaaagttagctttgcaatcttacatagtgaaaggctgctttaatctggaagaagtccttgatctgagataaaattgataaaaacgacatatgaatttgaatatttagctatttctttcctcgtcaaaaataagaataaaatcttgtaattcttattcagtatttggcgctaaatccatcattgccacatatcaaatacagggatatgttgtagaaaggtaacattctaatttaaatgccacccatatattaaaaacctgttttctgaatcataatgtccttttgatactagttctgaatatttgtgttaaaattttaatctgatttgttcattaaaattagttaatattgcttatgttgggactaataaagttttccgcacaaaatgtgtttctcctgcttccctggagaaaactgtattggctacttttaaataaattgttaccatctaagcaggcaggtcatatgactttgactgaagcatctaaccttgaagagcaagttccactgattttcaaggtgacttctttgctcaaaagggccttaatagtggtcactaaatgcaaaattctgttgatatttttcttgtagtccatcatttgagtaagcgatgtttatttaatgagaatatattaaataaaacatgatcattaatgactgtgaacatctttattacattaagatttaaggactgctcatgtattaacttcacacagaaatatactttctgtgtcattcagagatgttgaatatttccatttgaaaattatagtgtataacattagcattcttctaaagatcatgttcgtgtttaaattcctgttggaagccaggcatggtggctaacgcctgtaatctcagcactttgggaggctgaggcaggtggatcacttgaggtcaggagtttgagaccagcctggccaacatggtgaaacctcgtctctactaaaaatacccagctacttgggaggctgaggcaggagaatcacttgaacctgggaggcagaggttgcagtgagttgagatcgtaccactgcactccagcctgggcgacagagacagactctgtcttataaaaataaaaataaaataataattctattggcaacatatattaatttgaagttctaaagagtttggcagccgggtgagagagtgaggagatttggctttgacattagggaagttttcgcttggtgttaacaccagtaggcttctctgatgagggccattctgtccactcttttacctgatagattggtctaatgcacagtagactgatttagaaagagtagtcactagtggcatggcagaatcaataatgtagaattttgacaattcatatagtgctgatttctcccccaaatgtcagttattttggtcatctattaatagactaatacaagtcatccctttaatagaattttcagctcacagcctgctaagcctaagaaactgcttacaggttactgcttactgttttaagccgagttttaaaattgatgatcatgatagaagagataaataaactaaaattttagagaaatttaagaagggtatgtacatatgttttagtggtatcggggtgtatagggattaatagtcttctgtttaaattttttttttctaattttagaagtaatgtagaaaattcgggtcagggaaaggtaaaatatatggaaagttaaaaatattttatcatgtagtcataatttctagtaacatatttctttacaaataagacatagttgaaacagattgctacagttcttttaagagttgacatcttattgttgatttcttaccaccaacttcatccctccctttctttaaaaataaagggaaataataaaatttatttataaaactttgtggcattccacaaaataattctgaaagaattagtatggccaaaaaaatatgtatggtgttttttttttttctatttttaaccaaggaaaaactgtagagtgagtgagtgtgtgtgcatgtgtgtgtgaatgggtgtatttagcagaaaagtagtactgatgaatatcatggaatttatgtgatgttcactgtttcttccttagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtgggggtaggtaacacttgggcataatgatggtactcattttgtcattacactagatataaagagggctgagctacaactctgtttgaggaagtgtaagtatgtatatgttaaaaatagtagaatcaccaggaattgggaaacccatatttttattctgggctctaccacttattcatcatatattaaagcaagtcagacactcattctgaagttgagatttcgcagtgagtaaagtgttaataattcttgcctagtctacattatgggattgtgatgagattcctataaggttcataaatacagatatattgtaaaactataaagttttgtaaagtacctctctaatatgaggcaaacacagtatgtaacactatttggagggaccgtatttccttatctttttagcagctttgtttatcagtacattctataaacatttatttttggcttacattgtagtgtgtttctatagcatctgtatatggcactaattcccaactatatttccataataaggaatatcaaatacaaataaagggtccaagttttatttgtgattagcataaggaatatgctgacagcagctataaaagtataaaaattaggctgggtgtggtggctcacgcctgtaatcccagcactttgggaggctgaggtgggcggatcacaaggtcaggagatcgagaccatcctggctaacacggtgaaaccccgtccctactaaaagtacaaaaaaaattagccgggcatggtggcgggtgcctgtagtcccagctacttgggaggctgaggcaggagaatggcatgaactcgggaagcggagcttgcagttagctgagatcacgccattgcactccagcatgggcaacagagcaagactctgtctcaaaaaaaaaaaaaaaaaaaaagtttaaaaactagacgttgacatgattttacaataaggctgactgcttttgctactttgccaatcagtccttagtgctttgttcccataactgtggtaagcaagagcttacaaagaatacttaaaacaaacaaacaaacaaacaaaaaaaacactttttctcttttaatcagtccagagaacctttaaaagaaacaagatcggccagttgctgtggctcatgcctgtaatcccagcactttgggaggctgaggtgggtggatcacttgaggtcaggagttcaagactggcctgaccaacatgatgaaaccccatctctactaaaaatacaaaattagctgagtgtggtggctatttgagaggctgaggcaggagaatcatttgaacccaggaggtgaaggttgcagtgagccaagatcacaccattgcactccagtctgggtgacaagagcgaaactctatctcaaaaaaaagaaaaaagaaacaagatcttcaagcttaaggaaacaaaaacaaaactcagctgtgttaaatctgtttttagttgctatacatttctgctcagcttcatgtgatgcacattcatgtaattgtatcctaaattcctttgtactttttattttcttccttggtcttcaattatcttaagactaccaagaaaacaaaaattttaaaaatcttcttcagccggtcaggcgcagtggctcacggctgtaatcccagcacttggggaggctgaggcgggtggatcacgaggtcaggagttcaacaccagcctggccaacatggtgaaacgtcgtctctactaaaaatacaaaaattagctgggcattgtggcgcgttcttgtaatcccagctgctcaggaggctgaggcaggagaattgcttgaaccaggacccgggaggtgtaggttgcggtgagcggagatcgcgccactgcactccagcctgggctatagagtgagactccatttcaaaaaaaaaaaaaaaaatctgcttcagctattctgttaatcttttgacattacttagatggtctggaaataaattttgagaataacatgattagaagtgagagagtataagcatagttttggagatacactcagaatagcattatagattttctctttttactaattggaaaaatggcagttgttgaataatagttttcttccgtgacccttgtgacttaaaaaaaaaaaaacactgaaatgaaataatcgaaccattttctctaaacctttgaatctgagctctgcagttaggtttataatggtatatgaaacctattagatatatacttggaagtcatatgggatacaaaccctgcttttattatcttccccttttgactaacttgggtctcaagtttccttaattactgcacagtggaccttgatgttgctataaagaatgtgtagggctgggcatggtggctcatgcctgtaatcccagcactttgggaggccaaggtaggcagatcacctgaggtcaggagtttgagaccagcctggccagcatggtgaaaccccgtctctactaaaaatacaaaaaaattagctggttgtggtggcgagtgcctttaatcccagctactccagaggctgaggcaggagaatcacttgatacatttagttaggagagaaaatcatacttatgttagtaattgctgctgttcttcatatacttgtggttttgattgccagcaaattcctaacattttggaaaagaaaacagtaatgggataaagggtaagggctagagaggacagttttatttacctagatcttcagagaagcctgaagcctcttttaggaagtaacatttgaactgagaatgtaataaatacattttccctttcttctagttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgagggtatgtaacaaagggcttctggatccataatctcagctgtgaaattgaatgttagagggtgatattatatgaaaaaattctaggttatttttattcatagacaagtatttttagtgcacatttaaaagtttatgtaaattttgatgttgtttaatactactaatttaatatagtgtctgtgttacaaaggttaacattcctgggtgtcaaatacctacataaataaaattattggtgtttcatatgacatctgcaaaggaaaaaaagcctctgtttaaatgaaagcattattttccaaaaacataggaaatcaaaattattgttcagtgttttcttgttttgcttttctaacttatctgaattttttttaaaaaattgttttctagctaaagattccaggcttcaagatcagaggcagaactctcctgcagggaataaagaaaatattaaacccaatgaaacatcacctagcttctcaaaagctgaaaacaaaggttagagtttaaagagtcattaagcttaactgtaggaataggaagaagtatgtctaatttcatgcccatacagaatatttttgttcaacatttcttcttactattgtgatagataaatgtattgcttgacaaattccaaaatccaaatttaatatttgaaattattttctgatcttatatcttattctaatttctatcatctcatactaaaaagaatgtgatgttaaagtttaaaaataaacctgtgtcttaacagttcttaattttacaggtatatcaccagttgtttctgaacatagaaaacagattgatgatttaaagaaatttaagaatgattttagggtaagtattgtactaactgatgaatttgagttttagaaaataagcattactaaagatttatctatttataaaaatgcgttatgtatacagtcagaaacatcaaaccatatatgtagaaagcagaacatttttaaagtggtctttgcctatcctttaagtgggataactaaaatcatgagatttggtaacaacaatatgtaggtatcaaatgagagtatagccctgacatttgaaaccaccatagcacagcttactatttgatggtcatttgtactttgttcagtgaagctagatattagtagagcaaggccaagtcattaataatctagtgtggcaaatggaagatgtactggactctggtgttctgaggtagttggagatttatactttgtacacaaatatattgtggtcaaaatctttctgtaacattatttctctgtcttagcacaggctttacttaacatctctccttgattgtcatttcattcttttgcatgttatttactataggtatcgaggtagattttgagaccaaccaataaatcttcttgaaacttagcttcttagaaaggaaaatctaaataccagccttttaaaaaaagtagctgaattaaaggatgagtgaaccaaaggcaaaggtagcctttcctcagcctgtgttttagctttctaaatgttaacaatagcttcattcttgacttattggtaacattcaaaatactacttattatttcatactttagcacatgtatctattcagctttaatgctattaacagttgttaacctaagttttcatttgttggcgggcacggtggctcacacctgtaatcctagcactttgggaggccgaggtgggcagatcacctaaggtcaggagttcgagaccagcctggtcaacatggtgaaaccctgtcttgaccaaaaatagaaaaattagctaggcatggtggcgcacacttgtaatcccagctacttggcaggctgaggcaggataatcgcttgaacccaggagacagaggttgcagtgagccgagatcacaccactccactccatcctgggcgacagagcaagactgcatctcaaaaaaaaaaaaaaaaaaaaaaagtttttcaatttgttaaacaatagttaacacatacaaatgatacaaagaatattgaatatgatcatgtgcccactacccagcttagtaaataaagcattctaacacagttaaactcctcttatgtatctgcccctcctcagctgcttccccctgtttccttccaaaaggaagggtttcttttctgtgcagttctttatatttatactgcatatgaatatatctgtgagcaatagatgatattttgcataatcttaaatttgctataaagtcttttttttttttttaattgatcattcttgggtgtttctcgcagagggggatttggcagggtcataggacaatagtggagggaaggtcagcagataaaaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtgacacagcacatgtttcagagagcacagggttgggggtaaggtcatagatcaacaggatcccaaggcagaagaatctttcttagtacagaacaaaatgaaaagtctaccatgtctacttctttctccacagacgcagcaaccatccgatttctcaatcttttccccacctttcccccttttctattccacaaagccgccattgtcatcatggcccgttctcaataagctgttgggtacacctcccagacggggtggtggccgggcagaggggctcctcacttcccagaaggggcggccgggcagaggtgccccccacctcccggacggggcggctggctgggcgggggctgaccccccacctccctcccggatggggcggctggccgggcgggggctgacccccacctccctcccggacgggttggctgccgggtggagatgctcctcacttcccagacggggtggctgccaggcggaggggcttctcacttctcagacggggcggctgccgggcagaggggctcctcacttctcagacggggcggccaggcagagacgctcctcacctcccagacggggtcgcggccgggcagaggcgctcctcacatcccagacggggcagcggggcagaggcgctccccacatctcagacgacgggtggccgggcagagacgctcctcacttcctagacgggatggcggccgggaagaggtgctcctcacttcccagactgggcagccgggcagaggggctcctcacatcccagacgatgggtggccaggcagagacgctcctcacttcccagacggggtggcggccgggcagaggctgcaatctcggcactttgggaggccaaggcaggtggctgggaggtggaggttgtagcgagccgagatcacgccactgcactccagcctgggcaccattgagcactgagtgaacgagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgggcctgcaatcacaggcactaggcaggctgaggcaggagaatcaggcagggaggttgcagtgagccgagatggcagcagtacagtctagcttcggctcggcatcagagggagaccgtggaaagagagggagagggagaccgtggggagaaggagaaggagggggagggggagggggggagagggagagggacaatgatgtcttgctgtaggtattcttccccatttgaattttttcctcagcattattttttttaacatcattcagtctcctcttatactacacttggattgaatttaatatctcatgaagaaaaaacatttctactttgaagcatgtgaattagcatgtttttataacagctttattgagatataatttacatatataaataaaccgtttaaagtgtataaatcagtggtttttaatgagatataatttacatatataaatcaaccatttaaagtgtataaatcagtggtttttaaaatattcacaatgttgtacaaccgtcttctcagttgattttaaaacatactcttcacccccaaaagaaaccccgtgcccagtttagcagtcgttccacatttgcctccagcccttctctttcccctactcccaaccctaagcaaccgttaatctactttctgtctctatggatgggcttatttggggcaaattccatttcatacaaatggaataataaaatatgtggcttttatgactggcttctttcactcagagtagtgttataaaagttcatccatgttggagcatgtttcagtacttcatttctttttgtgactgactaatattccttgatgtggataataccacattttgtttatccattaatcagtttgtagctatttgtggtgttctcactgtttgactattctgaataacactgccacaaacatgagtgtgcagtttttttctcgtcctatcttttcatttcttttgtgtacctacctaggagttgaattgctgggtcatatggcaactgtgtttaaccttttgaggaactaccaagctatttgccaagatatctacactattttacattcccaccagcagggtatgagggtttctgtttctccacatccttgctaacacttattgtcttgtcttttttgattatagtcatccttgtgggtgtgaagtgttaacctcattgtggctttaatgtgcagttctttcatggctaatgatgttgaacatcttttgtgtttattggccatttatatatcttctttggattgatgtctgttcaaatctttacccattttaaaaattgagttgtctttttattattgggttgtgggagttctttatatattgtgtgtacaagtccctgttagatacatggtttgcaaatgttttctcctgttctgttggttgtctttttactttttcatcccttgaagcacaaaaatttttaattttgatgaagtccaatttatctgattttgaagtaagcttttggtgtcgtatctaagaaaatactgtttcatcaatcattaaggtttattactcttctgggtttttttaagaattacatttagaggtgtgatccatttggagcaactttttttttcttttgacacagaatctcgctcttttgcttaggctggagggcagtggtgcaatcttggctcacagcagcctcagcctcctgggctcaaatgagtagctggtactacaggtgtgcaccaccacaccttgctattaataacttttgtatttttttgtagagacagaatttcgccatgttgcccaggctggtctcaaacacttggactcaagtgacacgcccacctcagcctcccaaagtgaaaaattgctttcaccttgcactgcggactcgccctgaattctttcttgtgcaagatccaagagccctctctgggggtctggatcgggacccctttcctataacaatattatgagaataacatttgattttttttaagtgaaacaaattgttattaaaaaattaaaaaaggtcataggagagtgacttggtgctcagcccattttgagcagttatttaatatagcataaggtggggttcaaattcattctttatattaattttttatttctaattgacacataaccatacacttataaccatttttactgtgtaagttcagattcattcttccgtatgtaggtattagttgtcccagcaccatctgttaaaaagactattcttggccaggcacagtggctctcaacgcctgtaatcccagcactttgggagtcccaagcaggcagatcacatgaggtcaggagttcgaaaccagtctgaccaaatggtgaaaccgcatgtctactaaaaatacaaaaattacctgggtgtggtggcgcacacctgtagtctagtcccactactgtagtggctgaggcaggagattcgcttgaacccaggaggtagaggttgcagtgagctgagatcatgcactccagtgtgggcgacagagtgagactccatctcaaaaaaaagactattctttcctccattgaattatcttcacatgcttgttggaagtctgttgactacaaatgtgaaagtttattactggactctgaattgtcctccactgaatctctatgtcttatccttatggcagtaccatactgtcttgattagagttactgtattttaaaaggctgtactttttcagttagcagaaaacattttagctatcagcacaactttctgtaaaccttcattaatgcttgacttaaattccaagaaggagcaacataaaaagtcttatctctttaggagttttagtcttactacttttaggtgcctgaataaccaaatgtattatttagcctcttactaataactccttgatccataggggcataccaggaagaaaagaagtggtttttaaaaaatgagagtgggccgggcacggtggctgatacctataatcctaacactttgggaggctgaggcgggtggatcacttgaggtcaggagtttgagaccagcctggataacatggcgaaaccctatctttattaaaaatatataaattagccgggcatggtggcacatgcctgtaatcccagctactcaggaggctgaggcaggagaatcacttgaatccaggaggtggaggttgcagtgatccgagattgcatcagtgggcgacagagcgagaatctgtctcaaagaaaaaaaaagagagtggaaaaaaaaaatatgtgtcccagaacttaaattttaattaaaaaaaaataaaagagtgaactttctaattgttctcttcagataatataatgttattctcttatgttttattgcgtatttcctgtgtaccagatgctgttcttcatgcttgtatgttaaatcttgtctaacatctctgtcaagcaagttctgtttgtatctgcactgtgtatattaggcagcttgggcaaagagaagttaagtaatctgcccaaactcacatggctagtaagtaagagggctgaccatctggtgtttaagcttctagcagtgctttgaatagtaactaatgcatagtgcatgctgcactgtcagtcagtgattcattagagctaacttcatgacatgctcatagccccaaactgcatttgttcacaaatatctgtagtccttcatttaggcagaaatagaaataccttgtgtgtttgttgttccttcccttttgagccatatgcagagtgctgatagctttatttgtgtaagaattgctagtaatttgatctgttttgggttaataatgtgggttttagaggtaaatggacctaggtttgaatgttggcctctatacatcatgtgcgtaacattgtggcatgctatctacttcccccaagccaaaatgggttaattttagaacctgcttcatagtgttcctgtgagagctcgatgagatattgcctataaagtgtttagcatagtgcctagcacatggtatgtattcaatacatgttcattcttactagcaaaatatagatgacccagtattgtacagagtatgtacaatggtgtcattgtaccatttcatgtggagtcacataagaatttcagttttctgctgggcatgatggctcactcctgtaatcccagcactttgggaggctgaggtggatggatcagctgaggtcaggagttccagaccagcctggccgacatgatgaaaccccatctctactaaaaatacaaaaaattagccaggcgtggtggcaggtgcctgtaatcccagctactcgcaagactgaggcaggagaaatgcttgaacccgggaggcggtggttgccatgagttaagatcgtgccgctgcactccagcctgggcaataagagcgaaactccgtctccaaaaaaaagaaaaaaaaagaacttaagttttccattagatttagtatagtgcagagaggaaatacagcagagtgctatattccatatatagcaatatagcattagaacaatatattccaatacagcagagtgctatattcagataccaactagtggacttgctatttgtaagatggcaataatagtatctacatcaaatagggctgttgtgaagactaaatgaataagtctataaatagtttagaacagtgtctggacaggtacagtggctcatgcctgaatcttagcactttgggaggctgagacaggtggatagcttgagctcaggcattaaagaccaacctgggtaacatggtaaaaccctgtttctacaaaaaaatacacacattagccaggtgtggtggcacatgctaatagtaccagctactcaggaggctgaggtgggagaatcacttgagcctgggagatggaggttgcagtgaggtgagcttgcaccactgcgctccagtctgggcaacggagtcagaccctgtttggaaaaaaaaaaaaaagtgtccaacccatagtaagaaatgcagatgtgtttgacattgtaagaaaaagcaacaccaaaagtctgatttttgccttcactcaagaactcttatgataattaaactccgaagtccttggcaatatatatagttggtctgttatgtggatcgcctctactaaagatttttgtgaacaaatgaaagtttaagtagtaagttcctacatcgtgacttaaattgccagtgtgcccacataaataccctgtcaacatttgcccttagccacttgactctttagctatattggtaatgcagtaaagcttgcgatgcgccagagttgcataatgctgtttgccatgacaccaagagccttggtaatgaaaccattgaaattggtttgcctatactgaggctgaagaggtatcttggctctctaattttaaggcaacctttttggctgtgtaggtttctctttagcttgtttctcaccacctggggctgtggcttaggtccgttgtcctaacctgtggcttaggttctgtttttgttgcttgtacttgctcccccttttttcagccattcctgttttctttcttttgtagaggatgccatcttaaatcatcttcagccagtggtagcattttattttttctggtctgcaaacttaaaaacctcatcacttattttgctaatatctttgtcttctgttctttttgatggtccttggttttgcagtctactttaaaggtttttatttttttatgggtacatagtagacgtattattcatagggtctgtgagatatttagataaaggcatataatgtgtaataatcacattagggtaaatggggtatccatcaccatcatcattcatcatttctttgtgtaatgaacgttgcaattgtactccctcagttattctaaaaagtacaacaaattaatgctgactgtagtcaccctgctttgttgtcaaatactagatcttattcattctttatttaactttttaaattttaaacttattttatttatttatttttagacggagtctcactctgtcgccaggctggagtgcggtggcgcagtctcaactcactgcaacctccgcctccagggttcaagtgattctcctgcctcagcctcctgactagctggaactacaggcacgtgccaccacgcccagctaatttttgtatttttagtagagacggggtttcactatgttggctgggatggtcttgatctcttgaccttgtgatccggctgccacagcctcccaaagtgctggggttgcaggcgtgagccaccgtgcccggcctttaaaattattttaaatcattttaatatctttttcatttctgcctccggtcctgcagagttcttattcgttctttctaaattttctttgcacccactaatcacctcatttcccttcttctccccattacccttcccaacttctggtaaccattctgctatctccatgtgttcaattgtttttatttttagtgcctgcaaacgagtaagaatatgcaaagtttatctttctgtccctggcttattttacttaacataatgtcctccagtgccatctacattgctgcaaatgacaggatctcattcttttttatggctgaatggtaatctattgtgtatatataccacattttctttctccatttgtctgtcagtggacacgtaggttgattccaaatcttggctgttgtgtatatagtgccgtagtaaacatgggagtgcagatattccttcaataaactgatttcctttctgagtatatacctagcagtgcaattgctggatcatatggtagctctatttttagttttttgaggaatttccatactgttctccatagtggttttaccaatttacatgtccaccaacagtgtgtgaaggttcccctttatccacatcgttaccagcatttgttattgcctgtcttttggataaaagccattttaactggggtgagatgatatcttgttgtagttttaatttccatttttctggtgatcagtagtattgaatacctttcatatacctgtttgccattcataaataacgatgaggtcttgctgtttggcccaggctggtctcgaactcctgggctcaagcaatcctcccaccttggcttcccaaaatgctgaaattatagttgtgagccactgcacctggccttgtatgtcttccttttttttttgttttgttttgtttttgagacagagtctcactttgttgcccaggctggagcgtagtggtgtgatcttggctcactgcgccctacacctcccggattcaagcaattctcctgcctcctgccaccatgtctgcctaatttttgtatttttagtagagacgggatttctccttgttgcccaggctggtcttgaactcctaacctcaggtgatttacctgcctcagcctcccaaagtgctaggattacaggcgtgagctgctgcgcccagcctgtatgtcgtcttttgagaaatgtctattcagatcttttgcccatttttaattgagttactaaaattttccctatggagttgcttgagtgccttttatattctggttattgatcccttgtcagatgagtagtttgcaaatattttctcccattctgtgggctgtctcttcactttgttgatggtttcctttgctgtgcagaagctttttaacttgatgtgatcccatttgtccatctttgctttggttgcctgtacttttggggtattactcaagaaatctttgcccagagtaatgtccctgggagtttaatgttttcttttagtagtttcatagtttgaggtcttagatttaaatctttagtccattttgatttgatttttttttaatatggtgggacacaggggtctggtttcattcttctgcatatggatatccagttttcccagcaccatttattgaagagactgtcctttccccagtgtatgttcatggcttctttgtggaaaatgagttcacttagacgtatggattcatttctgagttctctgttctgtttcattgatctatatctttttttatgccagtaccatgccattttggttacaataatttgaagtcagataatgattcctcccgttttgttcattttgctcagtatggcttttgctcttttgggccttttgtggttccctacaaattttagaattatttttgtctacttctgtgaggaatgtcattggtattttgatagggattgcactgaatctgtagattgctttgagtattatcaacattttagcaatattaattcttctaatccataaacatggaatctcttttcatgttttttctgtgtcatcaatttcagtgttttaaagttgtcattatagaaatcttttactcatttggttaagtttattcctaagtattttattatatttgtagctattgtaaatgggattgcgtttaaaaaatttttcagattgtttgctgttaaatataaaaatgctcctgatttttgtgtgttgatttttgtatcctgcaattttactgaatttgtttgtcagttctaataggtttttcttttttggagtctaggtttttccaaatgtaagatcatattatctgcaaacaaggataatttgacttcttccattccagtgtggatgctttttatttctttctgttgtctgattgctccaattaggacttccgagtattatgttgaataacaatggtgaaagtgggcatccttgtcttgttccagatcttagaggaaagcctttcagtttttcccttttcagtatggtactagttatgggtctgtcatatatggcttctgttttgttgaggtatattccttctatacccagttctttggggtttttttgtttgtttgtttttgagatggagtctcactctgtcacccaggctggagtgcagtggcgcaatgttggctcactgcaagctccacctcctgggttcatgccgttctcctgcctcagcctcccgagtagctgggactacaggtgtccgctaacacgcccggctaattttttgtatttttagtagagacggggtttcaccgtgttagccaggatggtctcgaactcctgacctcatgatctgcccgtctcagcctcccaaagtgctgggattacaggcgtgagccaccacgcccggccaagggttttaatcataaggggatgtggcattttatgtgatataaattatatatttatatcatgtgatatatatttatatcatacacagtataaataatatatatatatattttttagtctttgtcttttattctgttaagatgtaccatgtttattgatttgcgtatgtcgaaccatccttgcatccctgggatgaatcccacttagtcatgatgaatgatctttttaatgtgttactgaattcggtttgctagtattatattgaggatttttgcataatgttcttcagagacactggcttctagttttccctttttgatgtgtcctttggttttgtatagggtaatagtggccttgtagaatgagtttagaagtattccctcttcctgtattgtgttggaatagtttgagtaggattggtattagttcttctttaaaggtttagtagaattcagcagtgaagccatcaggtccatggcttttctttgctgggagactatttcttatagctttgatctcgttacttgttattggtctcgttacttgttattgtatttgggttttggatttctttgtggttcagtcttggtaggttgtatgtgtctaggaatttatccatttcttcaaggttttccaatgtatcagcatatagatgctcatagtagtctctaatgatcctttgaatttcggtggtaacaattataatgtctcctttttcatctctcattttattatttgggttttctcttttttttctgagtctggctaaaggtttgtcagttttgtttatctcttcaaaacaatttactgttttattgatcttttgtattttcttcatttcaattttatttatttctgctttgattttttttatttcttctactgattttaggttttgtccttgcttttctagttctttaggatgtattggcagatgaagtttttccacttttttgatgtaggcacttactgctgtaaacattcctcttattgttgcttttactgtatcctataggttttgataagctgtgtttccattttcatttgtttcaaggaattttccagttttcttcttaatttcttcatggacccactggtcattcaggagcatattgcttaattttcatgtatttgtatactttccaaagttcctcttgttatctagtgttattttattttatttttatttttgtttttttgagatggagtctcgctctgtcacccatgctggagtgtagtggcgcgatctcggcttactgcaacctctgcctccccagttcaagtgattcttctgcctcagcctcctgagtagctgggattacaggcatgtaccaccactcctggctaatttttttttgtatttttagtagagagggggtttcaccatgttggtcaagctgatctcgaactcctgacctcagatgatccacccaccttggcctcctaaagtgctggaattacaggcatgagccaccgtgcccggcctctagtgttatcttattgtgatcagagaagatagttgatatgattttaacttttttgaatttttatttatttatttgtttgtttgtttgtttgtttgtaacagagtctcactctgttacccaggctggagtacatgtcatgatcttggctcacctgcaacctccgccttcctggctcaagcaatcctcccaccttagccttccaagtagctgggactacaggcacatgccgtcacatatggctgatatttttggattttttttttttttgtagagatggggctttgcgatgtgtcccagggttgtttcgaactcctgagctcaagcaatccacctatttcggcctcccaaggtgctgggattacagacatgagccactgtgccacgtcaaatctttagacttgttttgtggcttaacatagggtctatctttgagagcaatccatatgttgaggagaagaatgtgtattctatagctgttggacacaatgttctgtaaatatgtattgggcctatttggtctatagagcaaattaggtctaatgtttctttgttgattttctgtctgaatgatctgtccattgctgagagtggggtgttgaagtttccgactgttactgaggtctgtttctcttttttgctctaataatgtttgctttatatatctggatgctccagtattggttgcatatgtatttatacttgttataacctcttgccgaattgatccctttatcattatacaataatcttctttgtctgtttttatagactttgtctcaaaatctattttatctaagcatagctactcctgttcttttctggtttccatttgcatggaatattgttttccagctcttcaattttagtctatgtgtgattttataggtaaagtgtgtttcttgtaggcaatggatctttggtttttttttttttttttttgagacagagttttgctattgttgcccaggctggagggcaatggcgctatctcagctcactgcaacctccgcctcctgagttcaagcgattctcctgcctcagcctcccaagtagctgggattacaggcgcctgccaccaagcccagctaaattttttgtattttcagtagagatggggtttcagtatgttcgtcaggctgttcttgaactcctaacctcaggtgatttgcctgccttggcctcccaaagtcctgggattacaggcgtgagccaccgcacccagccttttttttaaatccatttagccactctgtatcttttgattggagagtttagtcgatttacattcagtgttgttactgattagtgaggacttaactactaccattttgttacttattatctggttgttttgtagtcctactccctcccttcccccttcttttttacttcctcttcgctccttttttccctccctcccttccttgttttgaaagtgattttctctggtggtatgttttaatttcctgctttatattttttgtgtatctgttgtaggtgtttttgatttaagatcaccatgacagctgggtgcagtggttcacacctgtaatcccagcactttgggaggccgaggtgggtggatcaagaggtcaggagattgagaccagcctggctaacatggtgaaaccccatctctactaaaaatacaaaacttagccaggcgtggaggcacgtgcctgtaatctcagatactcaggaggctgaggcaggagaattgcttgaacccaggaggcagaggttgcagtgagtcaatattgtgccactgcaccccagcctgggcgacagagtgagactccgtctcaaaaaaaaaaaaaaaaaagagatcacataagggttgcaaataacattttataacccattattttaaaccaatgacaacttgaaactttgattgcaaaaacaagcaagcaaagagaaaactaataaaaactctacacttcatctgcccgctttttaacttttgttgtttttatttatatctttattatactatgtcttaaaaaactgtagttataagccaggcgcagtggttcacgtgtgtaatcccagcactttgggaggctgaggtgggcggatcacctaaggtcaggagttcgagaccagcctagccaatatggcaaaaccccctctctactaaaaatagaaaaattagccggacatggtggcgggtgcctgtaatcccagctactcggaggctgaggcaggagaatcacttgaacccaggaggcccaggttgcagtgagccgagagtgcgccactgcactccagtctgggcaacagagtaagactgtctcaaaaaacaatacaaaacaaaacaaaaccctggcctagtggctcacgcctaatcccagcactttggaaggcaaaggtggggcgaatcacaaggttaggagttcgagaccagcctgaccaacgtggtgaaactctgtctctactaaaaatacaaaaattagccaggcgtggtggcacgcacctgtaatcctagctactcaggaggctgaggcaggagaatcgcttgaacctgggaggcggaggttgcagttagccgagatcgcgccactgccgtccagcctgggcagcagagcaagactctgtctcacaaaaaaaaaaaaaattgtagttcttatttttgaaaggttcattttttattcttcctgctcaaaatatgagtagtagtttatacaccacaattacagtgttacaatattctgtatttttctgtgtacttgttaccagtgagtttttgcaccttcaggtgatttattattgtttgttaacatccttttcttgcagattgaagaactttttttttttttttttttttttgagacagagtcatgctctgttaccagcctggagtgcagtggtgccatcttggctcactacaacctccaactcccaggttcaagcgattcttctgcctcagcctcccaagtagctgggattacaagcatgtgccaccacgcccagctactttttgtatttttagtaaagacggggttttgccatatttgccaggctggtcttgagctcctgacctcagggtgatccgcccgccttggcatcctaaagtgctaggattataagcgtgagtcatcgtgcccaacttggttgtttattttcaaatagcctgaattcaagctcactaatgttttctgctgcttgatacatttctgctattgagagactgatgcatttttcagtttgtcaattgaatttttccactttgggatttctgcttgattctttttactaataattattgcagtctcttttttaaatttataggattctgaatttgttctctgtattatcttggatttcgttgaactttctcaaagcattcagcttgaattctgtctgaaagttcacatatctcttatcacttgggaattggtcactggtgtcctttatttttagttcatttggtgaggtcatgttttctcagatggccttgatgcttgtggatgttcatcagtgtctgggcattgaagagttgggtattctgttctttgtagtctggttttgtttgtacgcattcttttttttttttttctgtttttgagacagagtctcgctctgtcgcccaggctggagtgcagtggcacagtctttgctcaccgcaacctccgtctcccggattcaagcaattctcctgcctcagcctcctgagtagctgggattacaggtgcgtgccaccacgcctggctaatttttgtatttttagtaaatatggtgtttcaccatgttggtcaggctggtctcgaactcctaacctcgtgatctgtccgccttggcctctcagagtgttgggattacaggcgttagccactgcatccggctcccattcttcttgagaaggtttttcaagtattcaaagggaattaagtgttgtcatctaagtcttcgctcactgcagccatacatgcattagagggcaccccaagactagtaatgttgtgactctgtagaggtatcaccttggtagtcttggggaagatctgggagaattccctgtattaccaggcagtctcttgtcctcttacatttctccaaacaaatggagtctctctttgtgctgagctgcttggagtttggggaagggtgacacaagcactgccatggccaccgtcactggaactgtacttggtctcacccaaggcctgtggcagctattttctggccaccactgatgttaatttaaggcccaagggtgctttagtcagtaggtgaagaatcctgcaagaactgggtctttactttcagtgcagcaggttcccttctggcccagggtgtgtctagaaatgctgcccaggagccagggcctgggatcgggagctttaggaatctgctttattgtactggggctgagctggcacccacttgcaagataaagtcctttttactcttctctcacctcaagcaggtgggtctccccatggacaccacagctgtgaatgtgcggggtcatatctgaagctggcacaatacgacatggcaccttgttttttattcaaggcacaagggctctttagtcagctggtggtgaatcctactaggactaggtatttcccttcaaggcaatgggttcccttctggtccagaatatgtctagaaatgtcatctgggagctatggcctagaattgaggcttcagaactatgcttggtgctttattttactgtggctgaactagtatccacattgcaagacaaagtcctccctactcttccctctcctcccagagctgtgagctgtggtacctggagttgggggaaggctggcacaagcactcccttggccaccctagctggtgtctcagtgggtcacatgtaccccaagtccactgactatgagcccagcacagtaccatgacttgtccaggaattgcagtccttctggtctagactgcctttcaagtttatttaggaccccagaggactttacccacggtggtggggcttaccaaaattaagattcttttggttttttttggcagagtttcgctcttattgcccaggctggagtatagtgacgcaatctcagctcaccacaacctccgcctcccgggttcaaataattctcctacctcagcctcctgagtagctgggattaccggcatgcgctaccacctctggctaatttttttgttttttagtagagatgaggtttctccatgttggtcaggctggtcttgaactcccgacctcaggttatccgtccgcctcggcctcccaaagtgctgggattacagaccatagtgcccagcccgaaattcagattctaatcactgggatggacaattcccctctgactagggctagtctaaatactccctctgtgggtgctggctgaattctgtcctatgctgctttccactgtgacagggcagcactgagtttcaatgcaaaatcccacagtcatttctctctctctcccccgagcacacagattctttctccaccccacactgcattgtgggggaatgtcaggggtgttggaggggcagttcaagactatcttccttatcttttttggtgtctttttccttgataggatgtcaaaactgggtactgtgatcgcttacctaatttttggttcttatgaaggtgctttcttgtgtggatagttgttcaatttggtgctccttgttggggatgatcactggaaggttctgtttggccaccatgctctgtctcttctcccctgccatctcctttttttacttaggggtttagaatgtctaactgaccaatatgtacagtcaggtctcattctgaattcacctacttaatgaccttccaagctgactaggcccagcgcttagtccagcctccatgacggtccctccacatcctaattagcctccctccagttcatttcacacaaagctgctgtgttcacctttctgaactataaatctgcccagtactctaccctacttaaaattccgtatagactgcccatttgccctgagaattaaaagccaaagtcctaaacgtagctttttaaaacttttttttttttttttttaatttttagatggagtcttgctctgtcacccaggctggagtgcagtggtgtgatcttggctcactgcaacctccgcctcctgggttcaagcaattctcatatgtcagcctcccaagtagctgggatttacacgtgtgccatcacgcctggctaattttttttttttatctttagtagagacggagtttcaccatgttggccagtctggtcttaaactcctgacctcaagtgatccacctgccttggcttcccaaagtgctaggatgataggtgttagccactgcacgcagccctgaacatagcttttaagttcctttattgtcatattccttttgacgagtctatcattttctgactcacttgtacatgtgtgtctcacccttggtccagccattggtgcttttctttacttctttatttttgttattttattttattttattattattttttaaatgagacagggtatcactatgttgcccaggctggtcttgaactcctgagcttaagcagtctgcttgtctcagcctcccaaagggctggaattacagtgatgagctactgtgcccagctcattggtgctatctttttttttttttttgagacggagtctcgctctgtcacccaggctggagtgcagtggcgtgatcttggctcactgcagctccacttcccaggttcacaccattctcctacctcagcctcccgagtagcagggactataggcgcctgccaccatgcctggctaatttttgtatttttagtagagatggggtttcagcgtgtgagccaagatggtctcgatctcctgacctcgtgatccgcctgccttggcctcccaaagtgctgggattacaggcgtgagccaccgtgcccggcccccattggtgctattgttttatgtgatagagccagcttctcccttttctttggatttttaaacatactcttccttttacttagactattctccatcccaacacctttcctaaacttctttcacaccttagactagctgacactttactgagaaacctttcttttttataggttgctttttctatagactctcttagcatttactcattttattgtgaagtgtctgatcttatttaaatgacaagtataagaggatagaaactatttcatatttttctcacccagcaggcacaatttctgacatgtggtaagcactcagtaaatattgaactttagaggctaggacatttgagtgctttggtgactgtggttgtgctatataggtactctgttattgttagtttatagtaaaagcattactcttaaagtatgaaaaaagccttattcagaacatttcatgcgtatagttaatattacgtagcttgtgctcatggcaaaaatgtattactaaagttatttaagatatttaagtataattgtttcctttatttagttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagtgagtaaacctggaacttagaccatcctgttactcaattaacttttttttttttaaaggcatttaggtccttccaactgtgaagaatccatctggacttttagactactttatacattgcccttagtttacaaacagctagtccaaacaaatgacatcttaagtaaatgaggttattgcaccctgtgctactcttctgttcttccccttttttgtaccccagggctagaaaaacaaggcataaattaagaaaagtttttctgtaaatgaacaggagttgaaaaattatcaattcaggggacctatctttactggattccactcattagtcaccctcactgtgctgctaggttgaaaaactgccactgtcaaggagagaagcatgcggtgcttctacttggaattcaaaatatttttcatcagaaactgtgttttagttaatgtttagatttgttaagatagacttaattctgcacattcagtatattaattaaatggacttttaggggctaacctcagaacttaactaccattgacttaggtgtttgggtaccaaacaatccagttaaagctgaagttttggaatgcagcttattgataaattggggactgcttattcttgatttgaggcaatttttttttacagccatgactttttccaggtatgtcatgtaaaatatcttctcacataagaattactgcatgctagaatattggtatgttgactggtagctcatacctataatcccagcactctgggaggtccaagcaggtagattacttgaggttaggagttgaagaccagcctggccaacatgtgaaaccctgtctgtactaaaaatacaaaaattagccaggcatggtggtaggtgcctgtatcccagctactcgggaggctgaggcaggagaattgcttgaacccagaaggtggaggctgcagtgagccgagatcatgccactgcactccagcctgggtgacagagcgagactctgtctcaaaaataaataaataaataaataaaaggatactgttatgttaagaattgcttttaaggatatttcataagtagctactgtcttttcagctcaagtgtttgttgattggccaggcgtggtagctcatacctgtaatcccagcactttgggaggctgagtcaggcagatcacttaaggtcagcgtggccaaaatggtgaaaccccatctttactaaaaataaatattaaaaaaaattagctgggcgtggtggcagtctcctgtaatcccagctaatcaggaggctaaggcaagagaatggcttaaactcgggaggcagaggttgcagtgagccaagattgcactgctgcactccaacctgagcaacagagtgggactctgtgaaggaaaaaaaaaaagtattttttgattgcctttgagaggaacggttgtatattactcagatttttaaaaaattgttcttttatggctgtattctttaagggattaaggaatgggcaatataagtgtatatgtttcaataaaaacgattagtgatcttctagtgagaacagtttaaatctatatttagcaattttttttaaattgtcaggtatggaagattttagagcaacgtaaagtccatgtagatttcactggcctttatattttttttaggcaagttaggaaatcaacattgaatcccaatgcaaaggagttcaacccacgttccttctctcaggtaggtttattactttctttgaggttatctagtcccaaaaaaagaaaaattattagtaatagtccttcttccatacctgccatctgaattttgttttagtgtgctgaaccaaccttctttcttttttttacatggccattaatgaatactttttaaacattaaaaaaaggtctttgttttgtcatcaattagatgtgatcttgggcaaatctttgaatttctctgacccagaatttgacgatggttggctagctaggctgtcaggtttatagatacgtcctctgcacctgagggttttgcatcactggattcaaccaaccatggatcaaaaacatagttaggataatctatactgaacacatgcagacgtttccttgtcattattccaaaacaatacagtaaagcatttaccttgttttaggtattataaataatctagagatgatgtaaagtatataggaggatatgcataggttgtatgcgaatactacatgattttatgtaagggacttgagcattccaagactttggtatcttcacagggtactgtaaccaatcccccacagatactaagagatgactgtactattgttattattcgactgagatcataagaagatatatttatttttaatttttaaaaacacttccatcagtttcttaaaaatagctgccactgtttttaatattttttaattgacaaagttttaagttcctactgaaacattttttcttttattgaaatgtgaaaatttatgtgctgtgtttttgttttcaataaaagggacatagttaaagcaagtaaaattagaaagactgggaaaatccgtctttaaattgcaataatagttcatctgttaccttgagataattgaatttattgttgtttttgtagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaagtaagtcatagaatttgatgttcacttagcctccccaattgtttgtatctgacaccaagcactctttaggttttcagtgacttgagggtgtgatggttatgcatatgcatttgaaacagacaggcatgcagagattcagtgtgttgttaagtatgaggacctaaatctgagaatgttttctgtgaaaaagatggtttagatttactgtagtttggggtttgttccttttagctgtgggtatgatctaattttttaatgactaatggagaatcaggaaaccttctcatgcctagctctctagcaatataaaactaagagtgacagaataccttgttattatcataggtgcctaatgttaattttttttttaattctctcaagcctttatacccaatacctatgacgcccatgccagtgaatcaagccaagacatatagagcaggtaaaggtgagaataatcctgcctgtgtttgcttgtagtttgcatgctgcatgaattgagtaactaagtttataatgaataaatagttgtagtttagctctgactttttgatgaggctatgcattggcttttgatgaacaacattacatagatattcacatggattttatgaagaaaaacaggggagaaaaaatgcccatcagttgtgattatatagtatcctcttcaaaaagagtaattggaggcctggtgtgatggctcacacctgtaattttagcactttgggaggccaaggcaggaggattgcttgagctcaggagcccaagatcagcctggacaacagagactttgtctctactaaaattcaaaaaaattagctgggcatggtggcatatgcctgtagccccagctgtttgggggactgaggcgagaggatcacttgagcccaggaagtagaggctgcagtgagctgtgattatgccactgccctccagcctgggcgacagagtgagaccccgtctcaaacataaatactggctgggcatggtggcttatgcctgtaatcccagcactttgggaggccgaggtgggtgtatcacctgaggtcagtagtttgagaccagcctggccaacatggcgaaaccccatctctactaaaatacaaaaattagccggacatggtggcacctgccgcctgtaatcccagctactaggtggggctgaggcaggagaattgcttgaacccgggaggcaggggttgcagtgagccaagatcgtgccactgcacttcagcctgggcaacagagtgagactccatctcaaaacaaacaaacaaacaaaaaacaaacaaacaaaaaaaccagactaattggctggacacagtggctccatgcctgatatcccagctggaggatgacttgaacccatgagttcgagagcagcatgggcaatatagtgagaccctatctcaaaaaaaaaaaaaaaagttaattccaaagctttttgatctgaaatctgatttaaatctgaacttaaatttgaagaagagggtttgctagattaatttactagattgctaaccttgctttatatatacctacagttatttccccaaagccagaatttcttttgaagcagaggggcaactaacttcaaccaatgttaagatcctattagaaggatgtttcggctaggcttggtggctcacgtgtaattccagcactttgagaggctgaggtgggcagatcacatgaccgggagttttaagaccagcctgggcaacatggcaaaaacctatctctgcaaaaaaaaaatagaaatcttagccagccgtcatggtgtgctcctgtagtcctagctacttgggagactgaggtgggaggatcaattgaaaccagaaggtccaggctgcagggaactgtgactgcaccactgggctccagcttgggtgaaagagcgaaaccctgcctcaaaaagaaaaataagatggatgtttctgcattaaaattagggagttgtcgtataatgtagttgcataaactagtattctgtgcttgtgtggttaaagagccttcgtagaaaaaatcccacatttttcttaaaaggaaatcttttggccaggtgtggtggctcacatctgtaagcccaacactctgggaagccgaggtgggcagatcacttgaggtcaggagtacaaaaccatcctggccaacatggtgaaaacccgtctctactaaaaatacaaagatcagctgggcatggtggtgcgtgcctgggtgacagagcgagactccgtccaaaaaaaaaaaaaaaaaaaaagagttcttttaatgttggaaaatgctaaagggttttttttttgccaaccagttaatttagagtgattaactgctatcagttgagaaactatagaaagtagaataatttatacagaaaagacatttctcagtgcccaataattgcctttctgacataaagttttcatttttcctgaattaataagatttcctcaatgtgtttttttgggtgttttgtgtgtgtgtgtgtgtgtgtgtgtgtgtgtgtgtgtgtgtgtgtatgtgtttgatacagggtcttgctttgctgctgaggctggaacgcagtggcgctatcatggctcaatgcagccttgacctcctgggctcaagcgatcctcccttctcagtcccctggatagcgggggctacaggtgcacaccaccacacctagctaatttttgtattttttgtagagatgggttttgccatgttgcctaggctggtctcaaactcctgggctcaagcgatctgcctggctctgcttcccaaagtgcctgcgcccagccaattttctccatgtttgacctaattgtgatttcatagatgttaactaaaactcttaattttcgttttctcagtatgctattttttttttttttagccttggaacatatgaacctgttgaaagaactctgcctgaaataatgtaatcaaattatagagtttaatcttattttgagggcctttagaaattctgagaagaaagtgggtttttttttttactgccattttaatgtagtgttaaggtgttcatgtatcaccagcaggtgtagctgttttcaatgattacttaaaacaatgcaatgggaactttttgttgtcattaaaatataaaaggttactgtagtaagagcaagcatgacagtttggctatctgatgggagagtcacattctaacttcaggaggtactgtctttttaatagaaatgatatactcagagtctgggcacggtggctcacgcctgtaatccagcactttgggaggccgaggtgggcagatcacgaggtcaggagatcaagaccatcctggctaatacagtgaaaccgtgtctctactaaaaatacaaacaattagctgagcgtggtggcaggtgcctatagtcccagctactcgggaggctgaggcaggagaatggcatgaacctgggaggcagagctggcagtgagctgagatggtgccactgcactccagcctgggtgacagagcgagactccgtctcaaaaaaaaaaaaaaaaaaaaaatagtagagaaagggctttgccatgttggccgggctggtcttgaactcctggcctcaagtgatccacctccctcggcctcccaaagtgctgggattacaggtgtgagccactgctcctggcctgaatataccacttttacctatcatcagttgatgaacatttggattatttcctttttctggcaatgagtaatgcttttgtggattttcatgtacaaattttcatatgaggctgggagcagtggctcatgcctataatcccagcagtctgggaggctgaggtgggcagatgacttgaggtcaggagtttgagaccagcctggccaacatggtgaaatcccatctctactaaaaatacaaaaattacactggcatggtagcgtgcacctataatcccagctattcaggaggctgaggcaggagcatcagaatcgcttgaacctgggaggcggaggctgcagtgagctgagatcacaccactgcaccccagcctgagtgaaagagtgagtctcaaaaaataaaaaataaaattttttttcatgtggccttagattttcatttctcctaaagtagaaatgctgtgatggaactgccaaacttttccaaagcagctgcatcattttgtatttctaccagtaatgtacaagtgttccagtttctccacatcctcataaataaccgatatgtctttggtttgggttatgtccattctagtggttatgaagtgtcattgtggttttttgtttttttgtattgttttgagatcgtgcccaggctggagcacagtggcacaatctcggctcactgcagccttcgcttcctgggttcaagcaattctcctgcctcaccctcccagatagctggggctgcaggcatacgccaccacaccaggctaatttttatattttttgtagagatggagcttctccgtgcttcccaggctggtctcgaattcctgagctcaagcgatccccctgcgtcagcctccagagtagctggggttataggcgtgcaccaccgcgctcggcccatttttgtatttttagtagagatggaatttcaccatgttggccaggctggtcttgaactcctgacctcaaatgatccgcctgcctcaccttcccaaagtgctgagattttagacgcgaaccaccatgccctgactataggttatctttttacttgcttgatggtgttctttgtaacacagtttttaattttgatgaagttcaatttatctgtttgttttttcttttgttgctgttgctcctgatgtcatatcagacaaagcattgcctaactcaaggccacagagatttactcctatgaaacgcctataaaactcctatgatttttatagtttagctcttaacatttaagtctacaatctcttttgagttaatttttgtgtatgagatgagagtagtggtccaggtttttccttttgcttgtggatatccgttgtccccacctcatttgttgaaaagactattctttcctcttaaattgtttgtttgtttatttatttttgagatggagtgtcgctctgatggagtggcgctaacttagcttcactgcaacctccgcctctcagattcaagcgattcccctgcctcagcctcctgagtagctggaattacaggggtgcgccaccacacccagctaatttttgtatttttagtagagacggggttttaccgtgttggtcaggctggtctcgaactcctgatctcgtgatctgcctgtctcctggcaccctgggaggctgagaggctgaggtgggaggatcacttgagctcaggagtttgagaccagcctgtaccattatgcctggctaattttagaatttatcttaaagtataaaatgtgaatccaatttatcttgttctaaatgactatccaaaatgttttaaccagttttattagtctgtaatttacatacaagaaaatgctcatctttttatgtttacattttaatgagttttgacaaatatatttgctcatgtaactacttgcttcatcagtgaagatggaaaacattgtgcctgttcctcttctctgtccaactgtactttattaccactagctccagttaaccagtaatctgccttcttttactatagattagatttatcctctttagatttctttttctttttttttttttgattaggtttttttttttctttttttacgtaaaaaaatctttttttggagacgtctcattatattgcccaggttggtctcgaactcttgagctcacctcagcctcccagagtgctaggattacagatgtgagccacctcagccagcccctagattttttttttttttttaataaatggaatcaaacagcgtgtaacagaggtgttcaatcttttggcttccctgggtcatattggaagaagaattgtgttgggccacacataaaatacagtaacactaatgatagctgatgaacaaaacaaaaaaaaatagcaaaacttataatgttttaagaaagtttatgaatttgtgttgggccacattcaaagccgtcccaggacgcaagttggacaagcttggtatataatttcatatgtgtgtcctaaacagtgtagtaatttgaatttcatgttagtatcagcttattcctttttgtttgtttgtttgtttttgagatggagtcttgttctgtgtcccagaattggtctgcaattccactgcctcagcctcccaagtagctgggattacaggcacgtgccaccacacctggctaatttttgtctctctctcttttttttttttttttttttttttttagcagagacgggatttcaccatgttggccaggctggtctcaaactcctgaccccaaatgatccacctgccttggcctcccaaagtgctgggattacaggtgtgagtcaccgtgcccagccagcttattcctttttattgctgggtagcatttcattttatgattataccacagttaatttacccattactagtcgatgggcatttgagttattgccagcttttggctattatgaatgaagctgctgtgagcatttgtgtacaagtgtttgtgtttttatttcttttagttaaatacctagaattggaattgctgaggtatggtaagtgcatatttcatttttttaaaaaatttattttattttttatttatttattttttttgagatgaagtctcactctgttgcccaggctggagttcagtggcgtgatttcagctcatggcaacctccctgtcccgggttcaagcaattctcccgcctcagcctcccaagtagctgggattacaggcgcgcaccaccatgcctggctaatttttttgtatttttagtagagacggggtttcaccacgttggccaggctggtctcgaactcctgaccacaagtgatccacccgccccagcctcccaaagtgttgggattacagatgtgagccaccacacactgcctggtaaatacatatttcaattaataagaaactagcaatcttctaaagtgattgtgtcattttacattccaactgatcaggtacatgtgtaggttccatgtgttctgcatccttgccaacacttggtattgtgttatctttttaatttcaacaggtctaatgggtgtcttatggtatctcattgtgatcttaaatgtacatttctctgatgatgactgatccaggagcacctcatcatgtgtgtgtttgttttcagctgtcaacctttttttagtaaatggttcaaatcttttttccattttatttatttatttatttatttgatggaatctcactctattgcccaggctggaacgcagtggtgccatcttggctcactgcaacctccgcctcccaggttcaagcaattcttacgccttagcctcccaagtagctgggattacaggcatgcgccaccatgcctggctaattttgtatttttagtgtaggtggggtttcaccatgttggtcatgctggtctctaactcctgacctcaggtgatctacctgcctcggcctcccaaagtgctgagattacaggtgtgagccactgcgcctgtcctaataatttctttttgtctcaatgtttctgcctgggtgcactggctcacgcctgtaattccagcactttgggaggccaacctggatggatcatttgagccaacagtttgagaccagcctgaggaacatgacaaaaccctgtctttgcaaaaaaaaaaaagaaaaaagaaaaattagccaggcacagaagcgcattcctatggtcccagctacttggggggctgaggtgggacaatcgcttgagcgaggttgcgggggtttggagggcgatggaggggtgatcgaggttgcagtgagctgagattgcactactgcactccagcctgggcaatagagccagaccctgtctcacaaaaaaaagaaaaaaaagtcatgtttcttttcttactgtgaaaataaagttactacttttagtaaattattttaagttatttatatattctggttacaagtcctttctcagaatattgtgaatattttctcccagtctgcggttttttttgaagagccagtattgttaattttaatgaagccttatttatcaagcttttctcttaaggttcatgcttttttgtatcataataagaaatcttttacgtaccctaggttatgaatgtttttatggttaggtatatggttgatttcaggttaggttttgtgtagggtgtgatgtaaaggtctagcttcattttctccaccataaatatttactcggtttctctggcaccagcctctgttttccattggtggctttattttttttctgttcttgaaacaagagtctcgatcttgttacccaggctggagtgcagtagtgtgaccttggctcactgcaacctccacttcccagggtcaagcgattctgcctcagcctctcgagtagctaggattacaggtgcccgccactacacccagctaatttgtattttttttttttttttttttagtagagacagggtctcaccatgttggccaggctagtctcgaactcctgacctcaggtgatctgctcatctcagcctcccaaagttctgggattacaggcatgagccactgcgcccagccatagtagctttattgaattcagttgactgtattgtatgtgtgtctatttgtgaactgttttgttgtattgatctttgtatatatccttatgccaattctctctttattgctgttactttgtaaccaacctttaagttcatatgagtctcccagttttattctcgtcaaaattactcttattctgcgttctttgaatttgcaaataaattttagaatcagcttgggattgtgcactgaatctttatatcagttctgggagaaatatcttaacaatatggaatcttcattgaggtcatcatatactgctccatttatttaagtcttaagtttcaccagtgttttctagttttctttgtatcagttttgtgcctgctttcttaaatttatcccttaatatttcatctgttttgtgctgttgtgagttatattttaaaaactttcaacgtttgtttattcgtaaatagagatgcacttgatttttgaatattgaccttgtgtcttgatgtgttggtaaacccactgtttctggcagccctttaagacttaaacatacaatcatgatctaatcaccatgttggtgtttttgggttttttttttttgtcttattgtactggtgcattactgaaaaaggcatgagattttgccatgctcccatttttaggggtgagacattgtctttcactattaagcatacagttaggtgttacttcagttcctaatttgcagaggtgggtttgttttctttttaatcatgaatggttgttggattatgttcaaatacttatcatctactaagtatatcatattgaccaggaacagtggctcatacctgtaacctcagagctttgggaggccaaggcaggaggatcgcttgaggccaggagttcaagaccaacctgggtgatgtaggaaaaccccatatctacaaaacaatttaaaaatttgctgggtgtggtggcacacacctgtagtcctaactacttgagaggctgaggaaggagaattgcttgagcccagtagtttaaagcagcagtgagctgtgattgtaccactgtactccagcctgggtgacagaaggagaccctgtatttaaagtgtgtgtgtatgcgtgcgcatagatggatagataataatgtaattccattatggtcatacaaactgatatgaaatgccattttatcatataacaagtgtctttttgtggttgaatttgtttctggatttttcactctgcttcactaatctaataggactaccttctcatccactcactgccaacattgattttttttttcagattaccttgaattttctgtttatttttccatatgaactctataattaacttactactaaaaaaatcagttgcctttttaaaaccaactgatctttaaaatatatcttggctgggcccggtggcaggcacctgtaattctagctacttgggagactgaggcagaagaattgcttgaacccaggaggcggaagttgtagttgagttgagattgcgcacctgtactccagcctgggtgacagagcaagattccctcttaaaaaaaaaaaaaaaaaaaagaaacagaaaagataaatctttttacaataatttgttccaattagggtccaagtcaggcttgcaatttggatttgtttatatgttgaagtctttttttttttttaattgtttcatattgtggtaactttttttttttttttttgagatggaatcttggctctgtcacctaggctggagtacagtggcacaatctcaactcactgcaacctccccctctggggttcaagcaattctcctgcctcagcctcccaagtagcccagccttttttttttgagacagagtctcgctctgttgcccaggctggagtgcagtgatgcgatctcggctcactgcaagctccgcctcttgggttcatgccattctcctgcctcagcctcctgagtagctgggactacattcgcccgccaccacacccggctaatttttttgtatttttagtagagacagggtttcaccgtgttagccaggatggtatcgatctcctgacctcgtgatccgcccgcctcggcctcccaaagtgctgggattacaggtgtgagccactgcgcccggccttgtatttttaatagagatggggtttcaccatgttggccagcccggtcttgaactcctgacctcaaatgatccacccgcctcggcctcccaaagtgctgggattacaggtgtgagccatcgctctcagccttgcggtaactttttattacgaatgtattgagacattaataacctaggccagtcatgtttcatccctacccattgtctcttaaaagctttgagtccactggattattctgaagcaaattctagacattgcatcagtttatccaccaacattttagtgtgtatctttaagttggttttggttttgttttttgtttttgagatggggtctggctttgttgcccaggcttggagtgcagtagtgcaatcatagctcactgctgctgcgaattcctggtctcaaaggatcctccctcctcagcctctcaagtaactgtgactacaggcacatgccaccttgccagcttttcttttcttgtcttgtctttcttcttctttgtttttttgtttgttttttgtttttttttgagacagagtctcaccatctttctatcttgcccaggctagtcctaaattccagggcttaagttatctttctacctcagcctcctaaagtgctaggattacaggccagcactttaggaggtgctggatgagccatcacacccagccaagtcataggtttttttgtttgtttgttttttgagacagtgtctaactctgtcacccaagctggagtgcagtggcatgatttcagctcagtgcagtctctaccaattgggcttaggtggtcctcccacctcaacctcccaagtagctgggactaaaggtgcgcgccaccatacctggctaatttttgtattttttgtagagacagggtttcgaattcctgagctcaagcagtctgcctgccttgactcccaaggtgccaggattacaggcatgagccactgcactcagccctcacagttttaattacagtttttcccttagtttttgtcttgttcatatccagcttgtcttgtatttttttcccacgatctgaattttgctgactgtatccctgtgttgatatttaaagtagacttctgtcccctgtaatctttgtaaactgatagtaaataatgaaggcttgatcagattgggttttttttttttttccccaatgtttcacagatgtgtgtactttcagtgaggagtcatgtaatcagtctttttcctgataggagtagtcagtgagttcctagatgttttatctatccaggagataatatgtccctttagcgccttaatttttttggtgtgttttttagcagccattgatgataattgtctagcccaagatcagttatttccttaggggttgtaaaatggtgacattcttttcctttcatcccttcttcaattattgcctggaatatttctataaagaaaaactttcccatatccagctgtttggttaccctgaggtatagctttcttaggaaaagtaatttaaaatgttaatcatttccctttttaaggcagtcttcaaaataatgagttggttttctgttatcctccaaaggtaaccagtgaggtggtttttttgtcgttggttcttactatcagtataaacttctggaattttttttttttttttaattttttggagacaaggtctggctctgttacctaggctggagtgcagtgggatgatctgggcatactgcagcctcaacttcccgagctaaggcaatccccccacctcagcctcccaagtagctgggactacaggcaagcaccaccgtgcctggcttaatttttgtatattttgcagagacagggtttcaccatgttgcccaggctggtgtcgaactcctgagctcaagcagtctgcctgtgtcagcctcacaaagtggtgggactacaggcatgagccaccatggcaggccagaatcacaataaacttataaattaacttgagaagaaatgattgatgtcttcatgatgttgagtcttcctgttcaagaacaaagtataccttcaatagcatattaaagtttatccttggctggatgcagtggctgacgcctgtaatcccacctctttgggaggcagaggtgggcagatcacctgaggtctggagttcgagaccagcctggccaacatggtgaaaccccgtctctactaaaaatattttaaaaaaagtattagctgggtgtggtgtgcacctgtagtcccagctactctggaggctgaggtaggagaatcgcttgaacccaggaggcagagagtgcagtgagtcaagattgcaccactgcactccagcttgggcaaccgagcgacactctgtctcaaagaaaataaataaataaaaataaagtttatctttaaggttttgtacatttttttcagtgtatgccttaggtaggttcttttttaatgttagtgtaacccagggacttctcttccattgcatcttctaagtaattacttatgaagtaccatatatgaaggctattgctgtttatatgttagtttttaccctgctcctttactaaattccaatcctttgaggtattggataaaaatatttttagcatttttcaaataacaggcagagtcaagggcttggtttcttttcttcccctcctgtcccctaccctccccttttttgagacagggtctcacttcttcgccgaggctggagtgcagtggtgcagttacggcttaccgcggcatctgcctccctggctgaaaagttcctcccacctcagcctcctgagtagctgggaccatagatgcacagcaccgcagctggctaatatttttgtattttttgtggaggcagtgtctccccatgttgcccagggtggtcccaaactcatgagctcaagcagtccgctcgccctggcctcctaaagtgtagggattataagcgtgagccactgcgcctggcctggggatcatgttttaacatgagaattagtggagacaaacacatgatatctaaataatagcaccatagtatacttgactagctttttaattattttttaaatatacaggaaggtaataagtaacaaagtaataatagtgaatagtttaagctcagttagcataatcgggcaaactttcatttgataaaagtgataagtagttttcagtggcttttttgtttaccagaaggaggtggtttttaaatacgtgcatccaagataaaatataaaaaaatgttcaggtttgctttcctacatagataaaataatatgtaactagctctcccaaatttcagcaacagttagtgaatgtttagccacaaatttgcagttaattatataatcagttcttaggattttatgaacaagttctatattctttgtgccttatacctagttgtaagcagtcattccacaattattttcctgaagtggcttggttaatgccacaccagaaacaggtcacagacaatagtgctgtaagaaatgtgtgaggaaagaggcacatgggaagtagctagctcgtgctggaggaactggaaaaaaacctcacatgggagatgacagttgagctgaattcttaactagagttgtaacagggcgaggcccttacatgcagaccacctgtgtggattaagataagacataaagtaatcttttaaaagaactattatttagaaacctggtatatgctacatggtgctgtgttatactgggtttgagaaagaatgggaagtgttacaaggattcagtggttggaaattaaggaagatagaaagttagtgttggatctgttttggctctttggtcatgcctttgtttttctcaaaatgaatgcagtgcccgtcccagaaaataccatatgagaagcgatttcataatgctgtgagagtctgttacagggacttgatcaagtctgagggccatgagagaaagtccctctgaggaagttgctttcaagctgacacctgaaggatgaagcagaattatcccagctgggatttgggaactggtgtttgaggctgaggactagcatgcatgataggaaaataacccagagtggcagaagtgggagtggtatgagatggcatcagagacgcagattcagggtcaaatcattcagagcctcctagaccatgtgaacacatgtattatgctgtggagatactgtttaataggcagtctgcttttttttctgcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcaggtaaggctggtaaggcctaactcttaatttttgtaccatataaaaaaacttttaatatggtaaagggattttcctttataatttttgcttttgtgtgatggtagggtagatagctaaggacttggggacccttttcaatatatattcgaaggttactgatgattgtaagaggttcagaggaaacagccaagaaagatttgagagtttacagctgtttctggaaatctggaaaccatggagttaaaaatcttaactaaagtctgcttggctctatttgcagtgttaatgtgctttctttattttttgtttgaacacagcatcctcatgtctatagtcctgtaatacagggtaatgctagaatgatggcaccaccaacacacgcccagcctggtttagtatcttcttcagcaactcagtacggggctcatgagcagacgcatgcgatgtatggtaggaagcactttgtttgtctcttccagtgtgtgtgactcttcttaatttaagtttctgaaaacatactctatctaagaataacctgaccttttatgacattgagggtcaagaatctgaaggaaaagatgaacccatttctttgcctgacttgctttataacttttggcaaatagtttctacttctgtacctggtcttcagatctctttcctgctttaactaaaatgtaatgatgtatataatggcaaagcatctttgtggagaaaggtacctttctcctcttcctcatcaatattatgctttggtatatcctgcctacgacatgcaagagaattttataataataaaagcataaaggtgttctccagcatgaaaacattttgcttcactacttgatctgagggtcactggcattacatattttttttgctgtttgttataatgataatactatgtttctacatcatgctgtattttaatggttgaatattatgtcatattagatatattttagacatgagtcacactttaaatataaccaatgtgaacagaatgctgaaatgaaaatgagaagtattttatgtaaaactaagcagtatttatatgtgagaataataagcaaaaaaacccatcttcgttttgtgactaaacagagaaatttgtgtagatcaacttagcagctgtctaaagtaccaaaataatagatttttcactgttgataatttaaaataaaatgtccatttgtatatcttatgatacagaattaatggattgcttcaaatgtttttcagaatatgtttttaaatagtactgatttcattaagatgttttgttctgaatatttctgagaactaccgtagtgtcgtttagttttcctatttgcgtttttggttgtttggagtaggggataattttggtttattcatacagttgaaaagtgtactgctatgagaatgagattatggttacatgtaactacatgggcatttcatttttaaagcctctttgaactttttgaaatactaagaatataaaatttttattttttaagtttagatgtcctgaacgagtatgtttaggcaaaattgagttatttaagaatttataggctgggcgcagtggctcacgcctgtaatcccagcactttgggaggccaaggctggcggatcatgaggtcaggagatcgagaccagcctggccaacatggtgaaaccccatctctactaaaaatccaaaaaattggccgggtgtggtggcatgtgcctgtagtcccggctacttcggaggctgaggcaacagaattgcttgaacccgggaggcagaggttgcagtgagccgagatcgcgccactacactctagcctgagcgacagagtgagactccatctccaaaaaaaaaaaaaaaaaaaaagaatttacagatttctggcaaaccttcttcttgagacattactacttttcataccacctctgtcctttttgaagaataaaagttttaacattccgtaggttaatgagaataggacttgggcagcagcaatcatccttcctgtcacctgtaacccacagcttatgctttcttcctggaggttcttgtctgccacaaaggctcactgctgataggaatttgtatatgatcaaaggtgtttagttttataaaacagttaagtccagtcttaattttccacattatcactttcaattttgtattgtggattacgcattttaaataaaaaattgtgtgattgctacattttggaaaacatttttttcaagaggcccatccgtaatttaattgtaaaagatactgacaaactaacttggtttattattttggttatgaccccgtcatttgacttgtctttagttgtcttaacggggactgaatatgcgtgcaaaggcacgattgatttatcatgctggcttttatgcaacttgtatatattttaacaattttcctgtttgctaaaggcttaggttaaaagttcattatgattgtttatacatttctggtgaatacatcatgatttaacaagtggaaagaacatctctttccttccattttctggcatactccccttggaatcagatctgaaacttttaagctaaaatttccattgcatttggagagtagttatttgtgtatgcatgcttttgagacattgtagcaataatactgtaatgttgagccgaatctttctcctcattgtgttcattcactgccaacatctggcttcatcttttggatgaatgttcattggttttgaaacagcctatagggtaaatactgtgtttgaggtacagatgattttcataactacttcctagaacatgtccatttgaagagcagtggggccttagaccccaaagtccatttatgtgtgggcaaataggaaatgttgcaaacaaaacaaagcactagatctaatgtccagtgaaatctggaatgaactagtcattagagccggttctttcatgccaggaaaaagttactcagccaaatctgaactactctcctgcagtttacacaggtggtatttaattgctgtctgtatggaggcaggctaggagcaaggctgtggacttgttgtgattgtcactagttaatcaagattccctttgtggtgcttaagaccctaaaaaggacactaggagctgggcatggtggctgacacctgtaatccaagaacttggggaggctgaagtggaggatcgcttagcccaggtgttcaagaccagtctaggcaagatggcgagatcccatctctaccaaaaaaaaaaaaaaaaaaaaaaaaaaaaagcccagtcatggtggcacatgcctgtagtcccacctacacaggaagctgagatgggaggatcacttgagtccaggactttgaggctacagtgagctatcatggcaccactgtaatccagcctgggtgacagagcaagaccctgtctctatttaaaaaaaagaaaacataagaaagaattgttttgttctatgccatcataagccataatttaatctgcttaagcatgttcttcattaaatctgcagtgatttatttgaattattagactttcaaagccttattatatcaaatataaacaaaatttgaagtacattcttataaactacaacaaacttacatagaagtgttaattttatactcatcttccctgaacaatttatattttataaatatattaaatatattgtcataaattttctcaaaggaaccaaatactttgagtatgaattgtgcttttctttttaagctacatcatatctaggtttttaaaacatttaatgcaaacagaagaacatgcacccagatgttggtgacaattttatgtcaccttttctcattcattaattgttatagccatagccaaaggcattgaaaacataggaccactaatgactgcaaaatgaaatcctgattattgtttttaaatttttagtatgtttaatacacatatgctaacattactgaacagttaaatgataaaataggataattattttattctaaaaaagtattgaccttgacctctttctagctatcttagaaagggcttttgtcaaaaaccttatctctttgatgtctctttttttgagatggagtctctccctgtcgcccaggctggagtgcagtggcgtgatctcagctcactgcacgctccgcctcctgcgttcacgccattctcctacctcagcctcccgagtagctaggactacaggcgcccgccaccatgcccggctaattttttgtattttgtttagtagagatggggtttcactgtgttagccaggatggtcttgatctcctgacctcgtgatccgcctgcctcagcctcccaaagtgctgggattacaggcgtgagccactgtgcccagcctctttttttttttttattttttatttattttttattttttttttaatttttgagaaggagtctccctctgccacccaggctggagtgcagtggcgcgatctcagctccctgcaaactccgcctcctgggttcaagcagttctcctgcctcagcctcctgagtagctgggactacaggtgcccgccaccacacctggctaatttttgtgtttttagtagagacagggtttcaccatgttggtcaggctggtcttgaattcccgacctcaggtgatccacccacctcagcctcccaaagtgctgggattacaggcgtgagccactgccccggcctctttgatgtctcttaatctaacttccatcattgcctctaccccatcccttctaagaagttactttaattttttttcctctcacatctactctttttttttttttttttttttttttgaggtagtctcactctgtcacccattctgaagtgcagcggtgcgatctcagctcactgcaacatctgcctcccaggttcaagcggtttttctgcctcagcctcccgagtaggtgggactacaggtgtgcgccaccacgaccggccaatttttgtatttttagtagagacggggtttcaccgtcttggccaggctgatctcgaacttctgaccttgtgatttgtctgcctaggcctcccaaagtgctgggattacagatgtgagccaccacgcccagcctcacatctactcttctaatccatctaattttgttttatggtgatgcttttacctttcagaaacagtaataatacaacttttccgactaactagagccattaggaagaattagatccagaatccttttttgatttgtttttggtagtttaatgcagataagtaagaaaatatagttaagttaaaaaaaaaaaaaatgaaaagcatccataatccctccacctgacaactgccttttaacattttgatgtgtatccttccaggtgtatttaaatacactcaaataccctacccctttatgtagacatgttttaataagaaataatattcatgtttatattcttgctatgatcctaaatttttggatccattactagataatctttcaggataatgacatttccattagtaatgtttttgcaaaattgtgtgtctattgaattaaacttgtaaaatagttttattttggtacatgatttatatcaaggttgttcagtagaatgccatgttggtgtttttattagataatgattttattccttttacttttaagcaagtcagcatgacaacttgacacctaagtacagaagaacagtgtcttccggtttagtcctttcttttaaaattctgtagcagtgtttaaagtgcttgtcatctcttatgaaaatgaattatgcatgaatacaaaaagaaattactaatatgtcaacctttccagaaaatttggaaaatgcacacctcaaaaggctaatttacctttctatttcccaaattcagcatgtcccaaattaccatacaacaaggagacaagcccttctttctactttgccagtgagttgggttttttatactaatttttaattgtacagtaaaacactttttaaaggatacatgttaagggagtagacttgttgaacaatattttccttgtgccagtcaaattattgaaagtacttatatatataaataattcagtttttaaaatggaaatacccaatttaagaaggctggagttaatgaaaaatggagttgtttcagaaatcaatttttgcataccaagcaaatgtgactgggaaatgcctaatattttccttgttagagaaacttcctaaacagctttatacacacacacacacacacacacacacacacacacaaacacacacacccaagccacaagcttggtataaatttaaaatgtttatttatacacacacacacacacacacacacacacacacacaccccaagccacaagcttggtataaacttaaaatgtttatttatattctgataagatgaaatttatgcctaccaggatttttaattgaataggattgatgaaatactaagggaaaaacttttcagtcctgtgcatggctaaaggtttaaaatactcaggaagggccaggcacggtggctcacacctgtaatcccagtgctttgggaggctgaggcgggtggatcatctgaggtcagcagttcaagaccagcctagccaacatggtaaaactccatctctactaaaaaatacaaaaatcagccatgcatgctggcatgcgcctataatctcagctactagggaggctgagacaggagaattgcttgaacttgggaggcagaggttgcagtgagccgaagtcgtgccactccactccagcctgggtggcagagcgaaattctgtctcaaaaaataaaatattcaggaagcagacccctcaggatatcttgagcttaagcaagagatcatgacctctcaggtcattatcttggacagcacaggtcccctctccccacctggcaaaaagtacagaaatagttgctccttcatggagaaagtctgggcagagctttcttctggaaatgaacttttaaggtacatttttcctatttgtagggcaatttgtaaaaataagggccggacgtggtggctcacgcctgtaatcccagtactttgggaggccgaggtgggtggattgcttgaggccaggagttcgagaacagcctggccaacatggtgaaaccctatctctaccaaagcatggtggcacgcacctgtagtcccagctacttgggaggcggaggcacaagagttccatgaaccctggaggtggaggttgcagtgagctgagattgtaccactgcactcaggcctgggcaacagagagagactctgtctcaaaataaaaaataaaaataaggctagtcttggactttggtatttaaataggaaggagtactaatatttgtagaaatcctttagaaatttgtgccattaatattgtcaccttgtatgaaatgttgtgttctagaggatattaaggattcaaattttatgttaggcacattttgagttattttggggtgactcaatgtctgactctactaaatgccatattagcatttaaaatgcatttgaccttaaatctttgttaattatgccatgacttggtatccaaaaataagctgatacatacatacatacatatatgtgtgtgtgtgtgtgtgtgtgtgtatatatatatatatgtatgtgtgtatatataatttatttggtgctaggaaatgttaaatttaatcctttaatagatgctctttaaaaaggagtcttgctgtatgtatatactattaaaggggaaactatgtctgtgattgtagtgtgtaaaagatagtaggtgattttattatgtactcaatttgaggtctcaaatgtagttatcctcaccatcttactgtctctgttagtagtttggtgttgttttcctggtaagtagctaaggtccttaatcattaacacctaagccttaattgccttagcacaacttcccctaaaagggagtatcagtactttttaaaagaaactaacagttgggctgctaatttaatctgctgcttcatttccccctgttctaagccattttatgatggtttggtcaagttgccttttattccccttttagagttttcaactttccttcacttccctttttctgaatttaacatcagatttacaagttggaagattttgttttgttttataagttttgcaatgctggtgatctcttatgacttgtgcatccaaagtcaaaatgacaaaacctagttacaaattaaacacacagctttctgtacttaatttgcttcagtgagatcacagctgaggaaactagttctggaatgtggttagtgttattaaggatttttgactgatcatatgtttagaatcttaaatatttatgtcaaggaacactgagtgggaaacttctggactaggtctggaccaaagaagcatatgtctttgattatctttaatctaaaagattttatgaagactaaagttttataaatagaagtttaactgatgaataaatcagtattacaaataaaattaactttatttttaacctctctgggatctttagccagaatgagcatatataacaaaagcagtgaaataatatgtgtgggtcagaacccactgcccttcccactccactctccttttccctgattctcctgtgttttttccttctttaccttatcttggttcctttttttttttttttcttttgagatggagtctcactctgtcgtccaggctggagtgcagtggtgcgatctcggctcactgcaacctccgcctcctaggttcaagcaattctctgcctcagcttccagagtagctgggattacaggcgcctgctgccacacccagctaattttttttgtatttttagtagagacagggtttcaccatcttggccaggctggtcttgaactcctgacctcgtgatcacctacctcggcccctggttccttttttgtctctcttgtcttccaagctatttttttccttggcttttaaattttcttcctaccctgctttgtgtcactgtcacttaactggcctatcaaggaaccgaactgtatttttgttactagtattgatttaaagtataagtttcacatttctcccaatttattattattatttatttatttatttgtttattttattttttgagacggagtttcgctcttgttgcccaagctggagtgcaatggtgtgatgtcggttcactgcaacctccacctcccgggttcaagctattctccttccccactctccctagtagctgtgattacaggtgcctgccaccacgcccagctaatttttgtatttttagtagagacagggtttcgccgtgttggccaagctggtctcgaactcctaacctcaggtgatccgcccgcctcggcctcccaaaatgctgggattacaagcgtgagccaccgtgcccggctccatttctcccaatttcaaattcaaggaggaaaagaattcctgattaaggtacttctttcagatcttttgagctagaacaaaaaaacaaagggaaatatttctaattaactctttttaaattttgtttacaacgtatgatacatattttacacatcctttgtggtttttgttcgtcttgtttttaatcaatgccttgcaagtttaccggtatttaggtagggaaaggattttgtttttgtttttttaaacaaagcctatgtacattcactcagcttgggtatttgtgctatgcatgcaaattagctatagattagaaaaccgtattatagtctttaaatactggtaaacttaaattgcagagatgccttttaaaaatgcatagtaaaaatatttcatctttacttttctcttcaaatgattttaagatttttacatttttccagttgatgaataacttaaattatgagatttcatgggcataattattttctatatttattgttactttttaatattcttaatactttgcttagaaggtatttaaaagtgaaatttcaaactttttagtacaaaatttcttgaataaataaagttacaaaaaaaaaacaaaaacctctgagattccgtactgtatctttatgaacctccatgaacagaatttgggatttgggaattgcttttccttagacagatttagattgttacaaatgacatttttaagaggctggggtggcggtaggggttagtgctaatggtttaacagtaggggaccatggacaactgtagacatcactatccagtagaacattttgtggctgggcgcggtggctcacgcctgtagtcccagcactttgggaggccaagacaagtggatcacctgaggtcaggagttcaagaccagccagaccaacatggtgaaaccctgtctctactaaaaatacaaaaaagttagccaggcgcgcctgtagtcctagctactcaggaggctgacacaggagaatcgcttgaacccgggaggcagaggttgcggtgagctgatatcacgccactgcactccaccctgggcaacagagcgagactccgtctcaaaacaacaacaaaactgcactgtccaccgtattagctacttagctacatgtggcttttttattattcaaaaataaatttttaggccgggtgcagttgctcacacctgtaatcccaacactttgggaggccgagatggacggatcacttgaggccaggagtttgagaccagcctggccaacatggtgaaaccccgtctctactaaaaatacaaaaattagccaggtaatcccagctactcagaggctgaagcaggagtatcactttaacccaggaggcggaggctgcagtgagccgagatcgctccactgcactccagcctgggtgacagcaagactgggtctcaaaaataaacaaacatggccgggcgcagtggctcatgcctgtaatcccagcactttgggaggccgaggcggatggatcacttgaggccagtagttcgagaccagcctggccaacatggtgaaacccgtctctactaaaaatacaaaaatcagccaggcatggtgatgcttgcctatagttccagctactcggcaggctgaggcaggagaatcgcttgaacccgggaggcggaggttgcagtgagccgagatggtgcccctgcactccagcctgggcaacagagcgagactctgtcaaaaattaaacaaataaatacatttttaaaatgaacgtaagatttttacaagtacaacaaactcaggttcgaaatttacatcaaatcttttagaccaagtcagtgcctatacaacttggaggagctggaagtaaacttaatgagtatgatgatgatggagggcctgttaataagccaccaagttagaaaaaaaggactgtcttatagacttatgggactgtgaagctcaggaaggcttcatcgtttgtacatcatttgttctagctcccagaagacgttcactactcttaaaaacattcagagactatgttgccacagttttcttgttaaaatattctggcatatgttaattcctacagtctggaaaattttcccagtgtataaacaaagctgctgtatccagtctaaactggatatgaaggaatattaatgccagctgtggcattggcagtggatgcacaggtgatcctagaactggctctttgccttgccctttcccctgctaagagatagctttgcagctggagacgtaactgttagggctggagagttggtggcccttagccctacaacacctaggattatagaactgctccatgtgcctagcctaaccctctgcacaccatttacgtggaatatacccagagccgtctatgctggtgactcggcagccttgcctaccagactgctggaactagggtgcctcttcccaaagctgtgcttgcttctctcaccaatcagtcctgcatatgtctgtgtttgctaacacgttatatgaagaatgtggggaactattttggaatcatttctgtgtatgggcttattatcttgagggattttaggatttgtttctcaagagagggctgggaactataccttgctagagttgtcttgagaacgctctattctcagctcattgcctcgtggaggttagttttttatcatcggtgtgctgtccatagtcactggaagcagtgaacacatcctactctgcttctgattctcaacttactgtttttgaagcacatgaacaggccaggcacggtggctcacgtctgtaatcccagcactttgggaggctgaagtgggcggatcatttgaggtcaggagtttgagatcagcctggccagcatggcgaaaccccatctctactaaaaatacaaaaattagctgggcgtggtggcacatgcctgtaatctcagctactcgggaggctgaggcaggagaattgcttgaacctgggaggcagaggttgcagtgagcctgggcaacagagtgagtgagacttatatctcaaaaaaaaacaaaaaacaaaaaactgaaagacatgaagaaatggtttttgtaccaaggtttggcccacgctgagattcacaaagaactggctttcagttcttatctttattttgatttaaactggcccatcatgttgtcctttgaagttagtctagtaaatttctttccaaagggctggggcactcagaagggagtttacttttctatatttatttcataaagcaaagatgggagatcctccattagggcttgggaaagtaaactgagtggcagaagggctcctgtgattagctgagagagactgtggtccttcggccctgatgatagatccctggccttgccacataccatacacagtgcccgcacccccatcccccaccacacccaatatagtctgtgccctcaggacattgctccagggcagtagcatggtgaggttagcctgatgatggccttgagctaaagagtgtgcacctaaaatgcacttgtttgagtagtttctgcctatgccttcaagttgcctttttgggaaaacctagtgaccgttaagagtaaatgcaaactaatttgattttaatatcatatgtagagctgtattatatgaaccaaatgctagtctgttaagcaatagctacacttattttttcaagacaatggatggtttaaatggagtcatctatagaaattggtagtggcgtgagttatgcattgtaaccatcaagaaagttcagttgatgaagtgtagaggagcgatggaggttgtcagacatcggttgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagtcctgttcaggtaagggcaactcagaggtctgcatggagtggcttctttatcctagtatctgagtgctttcttcaggtgccaggtatcgcatcgtcagaacacatggcatgtccaccctcgtgaagatggatacagctgtgcccctggggtggtggttttaagaatcacatttaaaggctgggcgcagtggctcacgcctgtaatcccaccactttgggaggccgaggcgggtggatcacgaggtcaggagattgagaccatcctggcgaacactgtgaaactccgtctctaataaaaatacaaaaaaattagccgggcgtggtggtgggcgcctgtagtcccagcttctcgggaggctgaggaaggagaatggcgtgaacccgggaggcggagcttgcagtgagcagagatcgcgccactgcactccagcttggacaacagcgagactctgtctcaaaaaaataaaaaattaaaaaaaatcacatttaagatacatgttgataataaggtgattggataagctctggaaacttgcagtaatgaaaaatcaaatttaacataaagttcataaggcaaattcctatttgcttgggactttttaatttctaaggtttatgtgatgaggttattttcctatgagcttcttgaattatgtttgctaatggaggcagttaaagatgtctttgatatctatcagttccctggggcagtagtcttttttgactttagtatgtatgctcagaagtttctaactgccagactgagaatcaggcttctgtaccctagaaaggagttgtccagatgggaggcacctccagccttgctcttaccaccctgtacattctcctgtactttccagtgaccctcatcataggcccaagtgtgcaaagcttagctttgtgggtatcccttggctgcttttcattaaagaagttttcctctcaattctttcctgtcgctttgcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagtaagcagctagaggctctcccagctaggaaaccctgtgtgtcatgccatttgcctgtctccctttccctctcaaatacacgtgatctggccctaagggaatgtttgtgtggttttgtcatgggatcagtgaaggtgctgattggtcagtcctttagttttccaactgagaccttaaaaatatctttgactctggaatgcaacccagtccttctttcctttctgtgtctgctttgctatgtctatatagcctcactactatatatatgtgtacatatatattcccctacacacttaccttggaagccaggcagggatgatggccttcacagagtctcagctctccgaagtgactaccggggcctgtcaacttgattgttactcacatgagttccagacacatctctccaattgttttccctggttatccatatatctgctttgaccataagttgtactcttgagagggcttggccttggacattggtgcagtgtaactagaagctggaagcacccaggtggtcccatttttctttaagagcagccctggaagcactttggagctcacctccagtgtaagctgctacaggtgaaaggtgtgcttgccatctcagtggttgctgtctgcatcagctgctgacaaaggtccctgcactccagggcccaggggattgtcttaatgaggagaaggagctgcactgaagttgggctctaacgctggccttgaggccctccctggggctgttacgggtgaattggctgtattagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtgtgggccagcgtggtttggtggagtcagcttcataagagctggggtcctgtaggtgtctaccagaggctggtggctaagtaggcatgtgaacttacatgtaagtcagggatccctaaaacctcactctgtttttgtgctgaaagggcaaaaaggttaacacagggaagctcaaatttgccatgtgcccgtttgaatatgtgagagtaaaaacggcatttcatccaaggcttatcgtagtctagaacagtgcacagtgtgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggagggactgtgacgatcagttcagcatcagggcctgaggcttccgggagccgagtctgtgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctgacatgtggggggttattaccatggcagagtttgattgtagctctggagaagatactgctgagaaagcgctgtggatggactggctttgagtgtagcgttagccccagcccctgaacaggggagagcgccctgtgattgtgctctactacttgatggctgccatggcgatacttcacagtctgacctgttattctgaaagcaatactggtgcttggctaatatttggggagggggtttgttaaggcctttttttctaccccatgaacaagtcttctgggagttttatctgaagtggttttacgtctgactggtttgtttctacccacccacccaaccctccccactttggtgcagatgggagggggaaaagcgaattcaattttgagttttgttcagctagcacgaggatagtttacaatcatgtgctgcagagacactaggctgatgtgtggtgttgccagttttctgtttcaatgttcgcttttctttttacagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactga

SEQ ID NO: 2 - DNA, 155409 bp, Macaca fascicularis
  misc_feature (3600)..(3607): n is a, c, g, or t
  misc_feature (36846)..(36855): n is a, c, g, or t
  misc_feature (53790)..(53799): n is a, c, g, or t
  misc_feature (64702)..(64716): n is a, c, g, or t
  misc_feature (79718)..(79723): n is a, c, g, or t
  misc_feature (119104)..(119112): n is a, c, g, or t
gcgaaagcggcccagcgcggcgccctcacgtgtccctcccggccccggggccactcacgttctgcttccgcccgacccctccgacttccggtaaagagtccctaccgcacctccgcgctcccccggcgcctcggcgcgcccggcctccgatgcgctcagtggccgcagctcctcggagtcccgtggcgggcaccaagtctcgccccttcgccgcagccaactggcccgggtggcgctcgctccagcggccggcgcagcggaacgggcggggcggcggtggcgcggcctctggacagtatccctccgccgcccctcccccgcccggccctggcccccctccctcccggcagcgctcgcctccctccgcctcagactgttttggttgcaacggcaacggcggtggcgcgttccggcccggctccccgcagctcctcggtctcggcgggcctccccgccccttcgtcgtcctccttctcccccgcggcagcccgggtgcccccccggccgcgccaacccgcgcctccctgctcggcgcccgcgcgtccccgccgcgctccggcgtctcctcggcgcgcccggctcccggctgtccccgcccggcgtgcgagccggtgtatgggcccctcaccatgtcgctgaagccccagcagcagcagcagcagcagcaacagcagcagcagcagcagcagcagccgcccgcggctgccaatgtccgcaagcccggcggcagcggccttctagcgtcgcccgccgcctcgccttcgccgtcgtcgtcctcggtctcctcgtcctcggccacgactccctcctcggcggccgcggcgacctccggcggcggtaggcccggcctgggcaggtgggtgtcggcacgccagccccctccgctccggtcccggcgtcccctcccccgcggcccgcgccgccgtccccgccccgtgacccgccgggctgcccggggtgggccgggggccggcagcgcgagggggactcgcttgggcctgagccccgaggctctgccggggggcgcagccggggtcctctaggattgtcaggcttgtccagcctcccgcagcatccgcgccccctcccccagcggtcaagatggagggagcgggcggcctcccctccccacgcgtgttgggaggggttttcgggtagcggcgatggtcagccccggatcccccttccccacgatcctccgaccgcagcgtggggatgctcgggcagcgcccccactaccagtttagatgtgaacgttggaggggtctagaggctttgatgtcgttttctggaacatgtgtctcccccctcacccgccatgggagacatctcgggaggggagaagttaggtctgcgtccctcgtgcctgttaaaggggtaggcaccgggcttctccggaatcatcagggtctgtctgggctctctccccgccccctcccagtcctgggaaagattggaggaccaggtggagacaggtgggccttggcccccgcacctctccgcgttcgagtccgagggcgcggcgggggctcccgaactcttttggaatcgtggggctccgtgtggcctcctgcaacgttccgccctcccccacctggggaagggaaggggtggggagtgcccggccccctcccggccttcctccttcccccgccaggcctctccggcgcgcgggtggtggccaatccgcattgctgatcgaggccacggtggagaaggtgcctctgaacagcggtgggcgagggccggacccaggctggaccggggagatccggggcggcagtgctggtggcagggggcgggcaccctgcgcagttatcccaacccccgccccaatttcggaaatgctaggagagagagattgcagcaggggacgtggtggggatcctgaaggcagaaatgcgggtgtttactggcgtcttttttcctcctaagctggggttgtggtagggactgggggctcagtgttgtcccggctagctgggtttgactcgagggtgtgtttgtgcaggagcgcctgttgggggtggcgggtggttgtcagttcgtatttcgcgaactaagaaaatgcttagtgttcaaagggagaagcaaacgtcaatagactccattccattgtggccggtgtccttaacttcgggagtgccgccagagcttaccaagggcacgcaagtccatttcccctgtgcctcaagtccatccgtgttgcaggcactgctgtgccttccttaggcctaggccgccgtcttgacagggccggtgaccggcgtcctccttaaataggcatcttgggctttggaaggtggaataagaggatttttcattcacctgagtattctttttgaaaacacattttcagcaacccctttccaaagaatttttatttacagcagaaattccccatcaagaggaatcagctggtttttaaggaattctgctgccttcaaagggggcggaaacagtcggttgtttgactttacacgccccgcccacccttccccttctgtgagtctgaagcatcccaaacactgcttagccaaactagttcagatgaagtgatcatttccccaggtagagggtaaattcagtttccttttttcgttggcatctagcaaaaaaatttaaaatacaatgtttatagaaaaggatgcattctgtttttactttcttaggtattagcaagagatttggcagatatattcaacatgttcaaatatataaacgttaaaactaacgtcgttaagttgcattgactatgaggcttaaaaattagactataatagaatttgcacctgagtagttggagtgatcaaagatatttggaatattttagtactacaaggtctttttttctgttccttgaggctttacaacagtttaaggttaatttagatttttccttgctttaagttcctttatttgagacctaaatggtagcccttattctttttgatgaataggtgaaattttgtttactgtgttggatttgcataatgtgaaattttattcttgtacagatcgttaatgtagtattactttgaatttgaatcactttcctccgttccttataaataagtttcagcttctagaatcttctgacttatgtttgtgtgtatcaacagtgaaaataagtttctgagagcaagggtgaaaaaagaaaacgcagcattggatttgacaagtttcgagatagcaaaatattcttgaaagtctggaaattcacatctgctttaagaaacatctcataatttgacttcttgtgtgtgtgaatagtttttcatgactttcagaagtgatttattctggccgggcgcggtggctcaagcctgtaatcccagcactttggaaggccgagacgggcggatcacgaggtcaggagattgagaccatcctggctaacacggtgaaaccccatctctactaaaaaatacaaaaaactagcggggcgaggtggcgggcgcctgtagtcccagctactcgggaggctgaggcaggagaatggcgtaaacccgggaggcggagcttgcagtgagccgagatccggccacggcactccagcccgggctacagagcaagactccgtctcaaaaaaaaaaaaannnnnnnnctgttttaggaaagataatgtaagcacaatattagaacataattttacttcaatataattcttttttttttttttttgagatggaatctcactctgttacagcccagactggagtgcagtggcctgatctcagctcactgcagtctctgcttcctgggttcattcaagtgattctccggcctcagcttcccgagtagctgggattacaggttcgtgccaccacacctggctaatttttttgtatttttagtgaggacgggattttgccatgttggccaggctggtctcgaactcctgatctcaagtcatccacctgccttggcctcccaaagtgctgggattacaggtgtcagctactgcccctggccaatttttgtatttttagtagagacggagtttcaccttgttggccaggctggtctcaactcctcctgacctcaagtggtctgccagccttggcctcccaaagtgccaggattacaggcagacatgagccactgcccccaaccattcgtctaattcttatttttgttttttacctttttgtttttatgtagtagaggtgattgtgtatgttattttgtagttagcttttttctcctgaacattgtattgtaaatgtaaatttttttttttttttttttgagacggagtctgttgcccagtctggagtgcagcggtatgatctcagctcactgcagcctctgactcctaggttcaagcgattctcccacctcagcttcctgagtagctgggtctacaggaacatgccaccatgcttgactaatttttgtatttttagtagagacagggtttcgccattttggcctcaaactcccaaccttaggtgatccacccgcccttgcctctcaaagtgctgggattacaggtgtgagccactgcgcctggctgtaaggtttttacttaaccattctattgttgggaattgggtttccacttttttgttatagatagtggtgcagtgaacatttttaaatagctttttgcttcagtgtaattatttccttagagaaagttcccaagagtggttttactaggtcaaagggtttcaggattttgatggcttttgctagcagtgctctattcttcttctttttttttttttttttaagagacagagtcttgctctgtcaccaagcctagagtgcagtggcgcgatcttggatcttggctcactgcaacctcctcctgggttcacgccattctcctgcctcagcctcccaagtaactgggactacaggagcctgccaccatgcccagctaattttttgcattttttagtagagacggggtttcaccatgttggccaggatggtctcgatctcctgacgtcatgatcctcccgcctcggcctcccaaagtgctgggattacaggtgtgagccactgcgcccgtccacggtgctctattattctttagaagacttgtattacttccagtgccaagaaggttgctcgtccatagaatggtttctttgtagtttctcaaatattgtggggaattttcaaaggaaaaattgcgtttttactgtcaagtgcatacattattaagtgcttttgttactggattatttatgtttgagtttaatttggttcctctgaggattttataaggtaatatatgtgaagatgttttgaaacctgtaaccactgttattaatgaggatacttggtttatctattgttatagtactgagttaagtgcaggaatgaaattcctgaggaactgttctaaagctttgttgttgttgttaacctctctttttcatctgaaagtgttttttattagctgctagcctatgaccaagttatttttggtaactttcatgtaatttcatggcactgttgggaattttcactggttaactcatcttctccttcttctacattcccttccccattaaaaataaaaatagggatttacaattctgttactctattcctaaacctaaataatatgacattagaattgcttgggatacaggattcagtgtgaataaaatatttttcttttagtgattttcagcttagtatttttactgcttctttctcttgaagcattgcaacttaaaaattgtgctgtttagccaggcgcctgtaatcccagttactcggaggctgaggcaggagaatcacttgagcccaggaggcggaggaggttgcagtcagctgagatcgcaccgctgcactccagcctgggagacagagtgagttctgtctcaaaaaaaaaaaaaaaaaaaagtgtgctgtggtttaatgtagttgttcatcatgcttccatttaaatttcaatgagaccgttcatcttttgcagttaaatatcttgtagaaggacctaaaatatctacattgaacatagctctagtgaagcatctatgtacacagggtttttgggattaatcagtgaacaaagcaagtatattgtccttttggagtttacattctaatgtgactaggtagacaatgagacattaaattaccagcctgtgtataatagtgtataagagctatgggattagaagaaagcagattaaaggtatagggagtgtgggaaggggaatgagttacaattttaaatggattagggggagcttcattgaggagctaacatttgagcaaagatttgaaggtcaggtatttagccatttgctttttatctagattaattagtcttgtggcctcattagtaatttataaggtttaaatggcatcatcctttgttattcttttatgtgcatattgatactaaccatctctgaagttagaccaaaaaagttaattgacattgagggtcattagaggtaaattgtagatggctattactaaccaaagaggcatgttttgtttttcttttgggcttatatattttacctaattagtttagtttttgtttcaagtatgtggaaaaaataaactttttaagttgccaaaacttgcattggttttctttttctttttttttaagagaaaaaagtaagtctgtagttgcttaaagatttcacattctgaaacagtgaaaacatttatgggatcagtcatggtgttcctttttttggttaaatgtaaacttgtattttcagtgttactctaattagcgatggtatataattttacataagggatattaactcatattgtagctatatagtagctgtatgttttgacttaaaggaggatctcaaggccaggtgcggtggctcacacctgtaatcccagcactttatgagacagaggcaggtagatcatctggagtcaggagttcgagactagcctggccaacatggtgaaaccccgtctctactaaaaataaaaaaattagccaggcatggtggtgggtgcctgtaatcccagcttcttgggaggctgaggtaggagaattgcttgaacccaggaggtggaggttgcagtgagccgaaatcatgccattgcactccagcctgggcaacagagtgagactctgtctcaaaacaaacaagaaaaaaacaaaggaggatctcattttctttgtcctaaatagctacagctgtgttaaaactgtcaccttagcaaagtacagttttttgctttgaaaggaattttaacattttagaagattgtcctcgagaattacaattttctttttttttttttttttttgaagacggagactcgctctgtcgcccaggctggagtgcagtggccggatctcagctcactggaagctccgcctcccgggttcacgccattctcctgcctcagcctcccgagtagctgggactacaggcgcccaccaccgcgcccggctagttttttgtattttttagtagagatggggtttcaccgtgttagccaggatggtctcgatctcctgacctcgtgatccgcccgtctcggcctcccaaagtgctgggattacaggcgtgagccaccacgcccggcgagaattacaattttctattttgactagatagtgatagtattttgatgttgtgtaaaagttaagcatgaacaaaaccctactttttttttttaggtatttcaagtaattgtgacaacttcaatggagatgtaaacagtttgttaacaggcacacctgctactgtctttttttttttttttgaggtggagtcttgctctgttgcccaggctgaagtgcaatggtgcaatctcagctcactgcaacctctgcctcccaggttcaagcgattctcctgcctcagcctcccgagtagctgagattacaggtgcctgccaccacacccagctaattttatttgttgttgttgttttgtttttgtttttgttttgagatggaattttgctcttgttgcccaggctggagtgcaatggcgcaatctcagctcattgcaacctttgtttcccgggttcaagtgattctcctgccttagccttctgagtagctgagattacaggtgcctgccaccccgcgcagctaatttttgcatttttagtagagatggggtttcaccatgttggtcaggcttgtctcgaactcctgaccttgggtggtccactgccttggcctcccaaagtgctggggttacagccgtaagccattgtgcgcggcctactctgtttctcaaagaacagtaacatcaacaacaaaaattcctaaatcttaaaaatggaaggcaaaaaccctaagctttgagagattagggaacttgcccaaagcaacatttgtaggattttattacacctctccatttattatttttcttttagagtcaaggtctccctctgtcacacaggctggagtgcagcctcaatcttcggggctcaagcatttctcctgccttagcctcctgcgtggctgggactacaggtacacaccagctggctaacatttaaattttttgtagagacagggtcctgccgtgttgcccagattggtctcaaactcctggactcaagcagtcctcctgtctcagtttcccaaagtgctgagattacaggtgtgagccactgcacagtgcccccctctttatttttatttttatttttaaattttaagttccagggcctctcccttgaaataaatggagacataatatatacacaagatcctgctgtgtattttaaggcaatggtccccaacctttttgacactagggaccagttttatggaagatggtttttccacaggggcaggggatgattttgagatgaaactgttctaccggccaggtatggtggctcatgcctgtaatcccagcactttgggaggctgaggcgggcggatcacgaggtcaggagttcgagaccatcctggttaacacggtgaaaccctgtctctactaaaaatacaaaaaagttagctgggcgtgttggagggcgccagtagtcccagctactggggaggctgaggccagagaatggcatgaaactcgggaggcggagcttggagtgagccgagatcgagctactgcactccagcctgggggacaaagtgagaccccgtctcaaaaaaaaacaaaaacaaaaaaagaaactgttccacctcagatcattacgcatttgttaggttcattctcattaagagcacacaacctacatccttcgccatgcgcagttcccagtagagtttgtgctcctgtgagagcctaacactgcacctgatctgacaggtggggctcaggtgctaatgctcacacagctcgtgttgtgcagtctggttcctaacaggctttcttttttctttctttcttttttttttttttccagacggagtctcactgtcaccaggctggagtacagtgatgccatctcagctcactgcaacctccgcttcccaggttcaagtgattctcctgccttagcctcccatgtagctgggactataggcgcatgccacgatgcccagttaatttttgtatttttagtagagacggggtttcaccatattgggcaggatggtctcgatctcctgaccttgtgatctgcccagtgctgggattacaggcgtgagccactgtgcccggccccctaacagtcttgttttaagaatacagtcacggacagtccttgaccttcaggatatctttttgtaaccttgattttggcttgctaaaataggaggtctattttcttatctttgtttttaatgtatgtagttctgtacttatgtggtgtgaaatctacttaaatgttaaatcctcggatatttatttattttgagacagagtctcactctgtcacccaggctggaaagcagtggcatgatctcggctcactgtaacctctgcctcccaggttcaagtgattctcctgcctcagccttctgagtagctggtattacaggcgtgcaccaccacacctggcaaagttttgtatttttttttttttttttagtagagatggggtttcaccatgttggccaggctggtcttgaactcctgaccttaggtgatctgcccgtcttggcctcccaaagttttgggattacaggcttgagccactgggcccggccttatttattttttgagacggggtctagctctgtcgcccaggagggagtgcagtggcatcatcatggctcattgcaacctcaagttctcaggcccaggtgatcctcccatctcagcctcctgagtatctgagaccacaggcatgtgccaccatgcccagcaaaatttttgtttgactctgttgcccaggctgaagtgcagtggcaggatctcggctcactgcaatctctgcctcctgggttcaagtgattctcatgcctcagcctcctgagtagctgggattataggcatgtacccccacacctggctaattttttttgttattggtagagatggggtttcatcatgttggtcagtctggtcttcaaccccgacctcaggtgatccacctaccttggcctcccaaagtgttggaattacaggcgtaagcccctgcgcctggccttttttttttttttttttttgtagggacagaggttttaacttgttgcccaggatggccttgaattcctgacctcaaacaatttgccctccttggcttcccaaggtgctgggattacaggtgtgagccactatgcctggctgatttaaattattattattatttgtgtgtgcgtgtgttgcggggtgtcatcctgtcacccaggccggaatgcagtggtgtgatctcggctcactgcaacctctgcctccatagttcaagtgattgtcctgcctcagcctcccgagtagctgggattataggtgtgtgccaccacgcctggctaatttttgtatttttagtagagatggggtttcatcatgttggccaggctggtcttggactcctgaccttaggtgatccaactgcctcggccttccaaagtgctgggattacaggagtgagccaccgtgaccggcttggtttagtttttgtttttattgttttttttgagacggagtctcgctctgtcacccaggctggagtgcagtggtgccatcttggctcactgcaagctccgccccccaagttcatgccatccttctgcctcagtctcctgagtagctgggactacaggtgcccgccaccatgcttggctaatttttttttgtgtatttttagtagagacggggtttcactgtgttagccaggatggtcttgatctcctgacctcatgatccgcctgcctcggcttcccaaagtgctgggattacaggcatgagccaccatgcctggcctggtttagtatttttatgagtctgggttgttaattaaaacttgtcacagctgttaaccttaactttttattttttatttttattttttttgagacggagtctcgctctgtcgcccaggctggagtgcagtggcgccatctcggctcactacaatctctgcctcctgggttaaagacatttttctgcctcagcctcctgagtagctgggactacaggcatgcgccatctcgcccagctaatttttgtattttagtagagactgggtttcaccatattggccaggttggtctcaaactcctggcctcgagtgatccacctgcctcagcctcccacgcctggcaaccttgactttttatttgctggtaattatctgtgtttgcattcatgtgaaaatttgaaattctcattaacgtttaacgatacttacatagattgcttgtaatttaaaccctgaagttgtgtcaagtgactataaaatgtcaatttcttttatttatttatttatttatttatttatttattttcgtgacaggatctgactctgttgctaaggccggagtgcagtgctgcaaatatggctcactgcaacctctgtctcccgggttcaagccatcctcccacctcagcctcctgagtagttggaactactggtgtgccccacagtgcctgcctggtttttttgtattttcagtagatgtggagttttgacatgttgatcttgaaatcatagcctcgagtgatccacccacctaggcctcctaacatgctggtgttacaggcgtgagccactgtgtccagcccgaaaatgtcagttttgtgccatgattaatagctaactacattttgggaatggaataaaatgtcattctgtaatgaagtctttttaaaactcattagttgtggtatgaggcttgttggcaatataagtgaacatggtttatttttattaactgtatcagagctttagaatattggtctcctgaagccattgccttgagaggctttattgaacagtgttgccaatgatcaaatttttttttttttctttttttgagactggatcttaccctgttggccaggttggagtatagtggtatggtcatggctcatttgcagcctcaacatcctgggctcaagcagtcctcctacctcagtctcctgagtagctggaactacaggtacatgcagccatgcccggtttttgtatattttggagagacagggtttagccgtgttgcccaggctggtctcaaactcttaaattcaagtgatccatccacctagttttcccaaagtgctttaattacatgcgtgaggcaccgtggctagccaggtcaaatatttttcgttgacatttttcatattgctttttaaagtcatgttaaaatgttcttaataatttttctaagtggaattaatcttgattataattttagttttttataaagggctggttttgaaacacgtactgactgcatttttcttttcaggtttataaacatttattgtggactttgtgcagttaactattttcattcctgaaacgcatttggaaatcaggaattaaagactaaatgtcttttcactgaagcttgagcaaattatagaaaggagaggtttttttttttttttttttttttttttttttttggtagaaatgggggtcttgttatgttgctcagactggcctccaactcctgggcctaaactcctcctgcttcagcctctggtctggagagttctttatggcctctttgagaacttacttttactttacacatgattctatctagctttcttttgtgatatacatattggcagcaagtagaaaagtaatattttcagaggcagatatattaaccgcaatgagaaataacagtagcgtgatagaaagttgaaagacttggctgggcacggtggatcacttgaggtcaggagtttgagaccagtctggccaatgtggtgaaaccctgtctctactaaaaaacagaaaaagggctgggcttggtggctcacccctgtaatcccagcactttgagaggctgaggagggcagatcacaaggtcaagagattgagaccatcctggccaacagggtgaaaccccatctctactaaaaatacaaaaaaattagctgggcgtagtggtgcatgtctataatctcagctactcaggaggctgaggcaggagaattgcttgaacccaggaggcagaggttgcagtgagccgagattgggccactgtactctagcctagcgacagagggagactctgtctcaaaaaaaaaaaaaaaaaagaaaaaagctgagcgtggggcaggacgtgcgcctgtaatcccagctacttgggaggttgaagcaggagaatcgcttgaacctcagagtcgaaggttgcagtgagctcagattcagattgtgtcactgtgtcccagcctgggtgacagagcgagactctctgaaaaatacaaaaaacacgtttggaagactgatggctgggcattgtgtctcacacctgtaattccaacactttgggaggctgaagcaggcagattacctgagcccaggagtgcaggtccagcctgggcaacaaaggcaatccccgtctcaacaaaaaatatttatactaaaaatttagctgggcgtggtcatgcacgtctgtagtctcagctacttgggaggccgaggcgagtggttcacttgagtctggatgttgaagtgagccgtgattgcaccagtgcactccagcctgggcattaaaatgagaccctgtctcaaaaaacaaaacaaagagactggagaattactaaaaaaaggacacaagagctcaaaaaatacaccattctgggaggttttttgttgttgttgttgtttttgagatggagtttcgctcttgtcacccaggctagagtgcagtggcaccatctcctctcactgtagctctgccttccgggttcaagcagttctcctgcctcagacttctgagtagctgagattacagacgttggtcaccatgcccggctaatttttgtatttttagtagagacggggtttccccacattggccaggctggtcttgaactcctgatctcaggtgatctgcctgcctcagcctcccaaaatgctgggaccacaggcgtgagccaatgcacctggctttttttttttttttttgagacagagtctcgctgtgttgcccagactggggtgcagtggcgcgatctcggctcattgcaagctccgcctcccgggttcacgccattctcccgcctcagcctccgagtagctgggactacaggcgcccaccaccacgccaggctagttttttgtatttttggtagagacggggtttcaccatgttagccaggttggtctcgatctcctgacctcgtgatccacccgcctcagcctcccaaagtgctgggattacaggcttgagccaccgtgcccggccaacacctggctttttttttgacatagaatcttgctctgttgcccaggctggagtgcagtagtacaatcttggctcactgcaacctctgcctcccagcttcaagcgattctcctgcctctgcctcctgagtagctgggattacaggtgcccgccaccacacacggctaatttttgtatttttggtagagatggggttttgccattttggacagtctggtcttgaactcctgacctcaggtgatccacccacctaggcctcccaaagtgctgggattacaggcatgagccatcactcctggcctgggagttttgactaagtttgtagctgtatactttaggccctaagggcactactgttttatagcacaatgtagttaattaatgtgctcataatggtgactcataacgccaggttaaatgatttttttatatctcccagagaagtatttttcaatcggcgggtcatgaccccttagtagattgtgaaattacattagtggattatgacaagcatttttagaaaaatgaataggaagtgttaggacacactgcattattgaaataattgtttttgagatggcgtttcactcttagttgccgaggctggagtgcagtggcccaatctgcctcctggattcaagcagttctcctgcctcagcctcctgattagctgggattacagacatgggccaccacgcctggctaattttgtagtttagtagagacagggtttctccttgttggtcaggctggtctcgaactcctgacctcaggtgatccaccttcctcggccttccaaagtgctgggattacaggcgtgagatatcatgcctgacctaatttttgtatttttagtagagatggggtttcaccatgttggccaggatggtcttgatctcttgaccttggaatccacctgcctcggcttcccaaagtgctgggattacaggtgtgagccactgcgcccagctgccaagaattgttttaagctttggtttgagttaatgtattatatactgcattgtaattcaaaatgtagtttttggccaactctaggcacattgcctatggactagtcctgctctgccttgagcagcagtggttcaattaattttttttttttttcctttttttgagacagggtctttgtcaccaaggctagaatgcagtggtgcagtctcggctcactgcaacctctgtctcctgggctcaagcgatcctcccacctcagcctcctgagtgactgggactacaggagcacgcccccatgcctggctaatttttgtattttttgtagagatggggttttgccatgttgttcaggctggtcttgaactctggagctcaggtgatccacccaccttggcattcagaaatgctgggattacagggatgtgccaccgcacctagcccaaaattttttaaagtaattttttattgatacagtcagaaagttactgctttagagctacagaaatgcagttaaaggtttgaggaagagttttgaggttatatctaagctagggttgtcagatttggcaaataaaaatacaagacactcagttaaatttgaatttttgatgaacattgactaattttttagtataattgtgtatcaaattgcatagaagaaagttacttatctaaagttgaaatttaactgagcatcttgtattttatctggcagctccagtctaagctggaatcatggctcactctttttttttttttttttccagtcgtagtcttgctgtgttgcccaggctggagtgcaatggtgtgatcttggctcactgcaacctcagcctcctgggttcaagtgattctcctgcctcagtctcccaaatagttgggattacaaggacccaccaccatgcccagctaatttttgtgtttttagtagagacagggttttgccatgttgttcaggctggtcttgaactcctgacctcaggtggtccgcccgcctcggcctcccaacgtgttgggattacaggcatcagctaccgctcccggccatggttcactctttagtaattaaatttaagttctatgaaagcaggaactttgttttattcactattgattgtatccctgtttcttggatggttggcacttactacttggtcagaagtttgggcaagttactcagccgctctcaggcttagtttatttattaaaagagaaagaattccttccttggctgggcatggtggctcatgcctgtaatcccagcactttgggaggccgtggcgggcggatcatgaggtcaggagatcaagaccaacctggccaacatggtgaaaactcatctctactaaaatacaaaaaattagctgggcgtggtggtatgcatctgtagtcccggctacttgggaggctgaggcaggggaatcgcttgaacccaggaggtggaggttgcagtgagccgagatcgcgccactgcactccagcctgggtgacagagcgtgtctctgtctcggaaaaaaaaaaagggaaacaataccttctttataaagtgagatactaaagtcttaatattttctgtttttatgtattcattttttgagatgggatcttgctttattgcccaggttggagtacagtattgcgatcatggcttattgcagcctcaagtgatcctcccgtctcagcctcctgagtagctgggaccacaggcacatgcaccattacacccttcaatttttttttttgttttcttgttttgttttggagacactgtctcgctctgtcacccaggctggagtgcggtggtgcaatttctgctcactccaacctccacctcccgagttcaagcagttctcatgcttcatcctcctgagtagcttggtaacacatgcgtgcaccatcatgcctggttaattttttgtatttttagtagagacagggtcttaccatgttgcccaggttggcctcaaactcttgagctcaagtgatctgcctgccttggcctcccaaagtgctgctccctacaatttaaaaaattttttgtagagacagtctcactgttacccaggctggttttgaacttctgccctcaagtagtcctcttgccttggcctcccaaagtgttggggttaaggctgtgagccagcacactcagcctagattattcttatgttctgttcttggcacatagtagatgttcaacaatgtagagtcaaacacatttggagttgaaatgactctagtgtttgttttgtttttttttttaaccagaaacacgagcactttattgaatgccattgtagaaaagtgtgtgaggataaagggctgatacaggacttggctttgggggcagggcgaggaatggaaggtggagtatgtgggattcagatcatgggcagagctcctggcctagatgatgcctcctgatctattgatagacatgaaagatcaacactaggatgatgatgagcagaatggtcatgatgatgtgcacagtcaggtcccagatgttcaggcacttggcgttggaggtgtaggcctgggccctggtcaggtcgccaaccattttcctgtccctagacttcacagagtagaccagtgctatgaagcccaggcagcaggagttcatgaagtaggtgttgaacagggaccagacaacatggtcgggcatggagttctcgctgtggatgtagatcatggtggacatcaggggagcatggttgtggggcacccccagcacagccacctcttgctcctccttgagcatctcatagttagggggatggccgacgttggtgggagtgaagaggtttggacagtgtggttcatggtgtccagggaagaccagctgtggtcgggttgctgggctggttctcagtgggcccctccctttgcctgatagtttggatttctctggctctggtggttttttagtactcattctatttacaggtgaataaattgagaccaagagggttatttgccagagtatctcatcattggctgcataaccgacattagaatctgatgtacttctatttctaatacattgcttttttttttttttttttttttttttttgagatggagtctcgctctgttgccgagactggagtgccgtggtgcaatcttgactcattgcaacctccctctcccaggttcaagctattcccctgtcttagcctcccaagtagctggtactacaggcacctgccaccatggtcagctaagttttatattttagtagagacggggtatcaacatgttggccaggctggtctcgaactcatgaccttaggtgatccacctgcctcggcctcccaaagtgctgggattacagtcatcagccaccacgcctggcctttcactgtcatttttctttttcttcatccttcctttcctttcttcttttctcccctccctgctgcctcctcccctcactccctcccccccttccttcctttctctacctctttttatttcttcttttatttttctttctctgtctctcccaccccttcctctctcccccaccccccacctactctctccccctgccgttttgttcctaagagacagggtcttattatgttgctcaggctgacctttaactcctgagcccagatgattctgcctcctgagtagctgggactacacccacctcccattgtcatcttttgtttttttggagacagagtctttctctgttgctcagggtggagtgtagtggcacgatcatagcttactgtaactgtgtaacctcgaattcttgggctcaagcattcatcccacctcagcttgctgagtacctggcctggggctacaggtgtgtatcaccatgtccagctaatttcttcccccgcaccacccccccccacaggatcttgctctgttgcccaggctggtgtcgaactcctgggctcaaatgaacctcctaccttggctttccaaagtgttggaagggattacaggcataagccactgcacccagcctcctctttcttcccatttaactcctaaccacaccgaactttctgtctgcagagaggagcattggtcaacagttcacaaaatggctaggcatgatggcgtgcacccatagtcccagctacttggggagctgaggtgggaggatcgctggagcctgggagttcaaggcgctgggcaacacagcaagatgtcatttctggccgggcctggtggctcacacctgtaatcccagcactttgggaggctgaggtgggtggatcaccggaggtcaggatttcaagaccagcctggccaacatggtgagacccccatgtctactaaaaatacaaaaattagctgggcacagtggcgcgctcctgtaatcccagctactcgagggggctgagacaggagaatcgcttgaacccaggaggcagaggttgcagtgagccaagatggagccactgcactccagcctgggtgacatagtgagactctgtctcaaaataaaaggaagtcatctgtactattgcatgttactcagtagtttctttctctttattgttgagtagtagtctattatatgcatgtaccagtttgttcatctactggtggacattgagttagcaggttttggctattaaaaataaagctggaggccaggtgcgatgtctcacgcctatagtcccagcactttgggaggccgaggcaggcggatcatctaaggttgggagtttgagaccagcctgactgacatggagaaaccccatctctactaaaaatatgaagttagccaggcgtggtggcgcatgcctgtaaacccagccaggaggctgaggcaatagaattgcttgaacctgggaggtggaggttgcagtcagctgagattgcaccattgcacactccagcctgggcaacaagagcgaaactcttgtctcaaaaaaaaaaaagaaagacaaaaataaagctggtgtgaatatttatgtacaagttttgtgtgaacatacgattttatttctcttggttggcatgcatggaaatgagattgctgggttttgtggaaagtgtttatttttccagggtacatataatcctgtgagtgtttatttaattttaaaagtaattgctaaactgtttgctaaagtgactgtactatattttcttcccctaacagtgtattaattttttttttttttttttgagacagggtcttgctctgtcatccagggtggagtgcagtggtgcgatattgtcttactgcaacattgacctcctgggctcaaatgatcctcctgcctcagcctcctggctgggaccacaggtgtgtaccaccacacctggtaatttgctttgatttttagtagagaagaggtctcactatgttgccctgactggtgttgaactcttgggctcaagtgattcgtctacctcagcctcccaaagtgctgggattacacgagtgaaccactgtgcctggcctcattgtgggtttcttttgcatttccctaatgcaaagtgatattgagcatcttttcatgtgtttatttgacattcataccatctttggtgatgagaaactgtgtttatgcattgcttaatgatggggatgtgttgtgagaaattttttaggtgatcacatcattgtgcaaatatagagtatacttacacaagcctagatggtatacctactacacacataggctgtggtacacagtattactcttaggctacaaatctatatagcatgttactgtactgaatattgttggcagtggtaacataatgttaagtatttatgtatctaaacatatctaaacatagaaaaggtaagttaaaatacagcatagaagatagaagtggtatatctgaataggtcacttaccatgaatggagcttgcgggacaggaagttgcttgggatgagtcattgtatgagtggtgtgtgaatgtgcaggcctaggacattactgtatactaccatagatgaacactgtacagttaggatacactaaattgataaatatctttcttagtttgttttttgagacagagtcttgctctgtcgcccaggctggaatgcagtggcattatctccgctcactgcagtctcggcctcccaggttcaagcgactattctgcctcagcctcctgaatagctgggattacaggtgtgtgccaccacacccgactaatttttgtgtttttagtagagatggggtttcaccatgttggccaggctggtctcgaacttctgacctcaggtgatccacctgctgcggcctcccaaagtgctgggattacagatgtgagccaccgcacccggccagagatgaggtcttgctgtgttgcccagggcgttgaactcctgggctccagcaatccttccacctcagcttctcaagaagctgggactgtgggtgcacaccatcatgcctagccgttttgtgaactcttgaccagtactctctgcagacagaaagttcagtgtggttaggagttaagacttgtaacctctgacttcaagtgagctacccaccttgacctcccaaagtgctgggattacaggtgtgagccactgtgcctggtcaaaaatacctttctttaagaataaatttaatttaacttactagttgatcattgtatataggtctgttgttaactgaaacatgcagtgcatgtctttatttgggatctgacttatgtggaagtatttgcattatcttccttctagatttagagcatcttgacagtaggaacaagtgccttgtacaactttgtatgcttagtaagttatcaatttgctgtggccaggtgcagtggctcacgcctttaataatcccagcactttgggaggccgaggcgggcagatcccctgaggtcaggagttcaagaccagcgtggccaacatggtgaaaccccgtgtttgtttgtttgtttatttatttatttttgagatggagttcactctgtcgcccaggctggagtgcagtggcgcaatctcggctcactgcaacttccgactcctggtttcacgccatctcctgcctcagcaggagtgggactacagccacctgccaccacgcctggctaattttttgtatttttagtagagactgggtttcactgtgttagccaggatggtctcaatctcctgaccttgtgatccacccgcctcggcctcccgaagtgctgaaattacaggcatgagccactgcgcctggcctaccctgtgtttattaaaaatacagaaattggctatttgtggtggcacacctatagtctcagtgactcagaaggttgaggcaggagattctctttttttttttttttttgagacggagtctcgctctgtcgcccaggctggagtgcagtggcgcagtctcggctcactgcaagctccgcctcccgggttcacgccattctcctgcctcagcctcccgagtagctgggactacaggcgcccgcccctgcgcccggctaattttttctatttttagtagagacggggtttcaccatggtctcgatctcctgaccttgtgatccgcccacctcggcctcccaaagtgctgggattacaggcgtgaggcaccacgcccggccaggagattctcttgaacccaggaggcagtgagcagagatcgtgccggggacttcagcctgggcgacagaacgagactgcgtctcaaaataataataataatttgttgaatatgtgactattggttttatttttattttttgagctggagtctcgctgtgttgcccaggctgaagtacagtggtgtgcagtggtgcaatcttagctcactgcaacctctgcctcctgggttcaggtgattcttctgtttcagcctcccgagtagctgagactacaggcatgcactcctgtgcctgactaatttttgtatttttagtagaaatggggtttcaccatgttggtcagccttgtctcgaactcctagtctcaagtgatctgcctacctcgaccttccaaagaggtgggattataggtgtgagccatggtgcccagccagactattggttttgttttgttttactttattttattttactttatttattttaagatggagtttgtttctctcttgtcgcccaggctggagtgcagtggcatgatctcagcttactgcaacctccgcctcccaggttcaagcgattctcctgcctcagcctcctaagtagctgggattacaggcacccaccaccgtgccttgctaatttttgtattttcagtagaaatggggtttcaccatcttggccagactgttctcaaactcctgacctagtgatccacccacctcggcctcccaaagtgctgggattacgggcgtgagccatcgtgcccggctgttggttttattattaggcagtaggagttgaccctgtcaagaaaaaactgtcatgtagaaagcatggcatttagaggcataccatgtttaattccatacccttttttttatttttggtatacctcttgcttgtgaggcttgggaatacagtagtgaataagccagatgaggtctctctctttctggagcttatgtgatagtatagactagacagaaagttcacattacccctgccacctgatggtattgaggtgtttgagatggtactgtttacttctgcctcataaaatcttaaaaggagttcttttagatgaagagaaaaacaaaacaaaacaaaaccagaaaaaagaaaaaccatctgaagaatgggtctgggtcatgtctgtaaacctccccacgccatggggagactgaagtgggaagggtcaggagttcaagatctggctgagaaacataacaagaccccatctctacaaaaaatatttttaattaatgggggatggcagcacacacctgtaatttcagctactcacgaggctgaagcgagaggattgtttgagcccaggagttcaagattgcagaagctatggtcacatcactgcgttccagcccctctcatcagcagtctggtatgttgctaagggtcttgttctttttagtgcttcagggacagccactggctaggcacaaaaataagtatgtttgagaagctttctgacctcagcttgtaaaaattgattagggtcataattaaaaaggagggaaacaggattgagtggaccgggccctaccctgagtttattctcccagggcatacataatctcatgtgattaccacatagccctgttagatcatccgttatcctgtccccattttacccatgaggaaatgaaggcccagagaggttaagtgacctattcagattcactcaaagtggcagagatggaatgaatgagttactatcattgtgttttggatctctgaaaggtatatgcaagtgagaacaggacaagaaaactagtgatggtattaaaaaatgttatgattagtttcttttaatcagtcaggaacttgagtcactagcttctctgggtgaaggactatacttcaacaatgtgaaaaatggaaagaaatgaggaattttcgctagatgcagtggctcacacctataattctagcactttgggaggccaagggaagaggactgtttgagcttaggaattcaagaccagcctaggcaacatagtgaggtcccatctctacaaaaataaattagctgggcatggtggtggatgtctatagtctcagctacttgggaggctgagtcaggagggtcacttgaacccaggaattcgaggttacagtgagctatgattgagccactgtttaccatcccaggtgacagagaccctatccccccactgccaaaaaaaagggaagaaataaagaaaacgaggaatttacatttgtgacagatagggaatttagttattcatagtctataaatgctataggaagtctccatacttttttttttttttggagacagagtcttgctctgttgcccaggctagagtgcagtggtgcgatctcggctcactacaagccctgtctctcgggttcacgccattctcctgcctccgcctcccgagtagctgggactacaggcgcccgccaccgcacccagctaattttttgtatttttagtagaggtggggtttcaccgtggtctcgatcttctgacctcgtgatctgcctgccttggcctcccaaagtgctgggattacaggcgtgaaccaccgcacccggctggaagtctccatactttttaacccaatctaaaagggtgaggaaatatataagaatgtctattgattattaaaattttttctatataaaacattttagaaaaaaactagcatttctgagccaagtggtagtagtggccattttttctgaagaaaaaaaccacatttagctatctatgatgtgaaaagagatgatgaacattttatttatgtaataaatgttatgtaataaaataaataccatttattgtgtgcctattaggtttcaggagagctgtgccaagagcattacttgtatatcttttaagtcttataacagcccagcctgtcagactggtagtgccatatcctttttacagatgaggaagtgatgaatatgagaaattaaggaaattgcccttaggtcaaagagataggaagtgacaaagctgagatttttaaccttgtgagatttcaaagtctttgctttttaataactgttccactgcctgtaatatagagatatgacaaaagccactaaaaattagtgaagaagactgagagcagtcgcttacgcctgtaatcccatcacttcgaggggctgaggcgggtggatcacctgaggtcaggaatttgagaccagcctggccaacatgactaaaccccatctctactaaaaatacaaaaaaattagccaggcgtggtggcaggcacctgtaatctcagctacttggcagactgaggcaaggagaatcgcttgaacctgggaggtgaaggttgcagtgagctgagattgctccattgcactccagcctgggcgacaaagcaagactccatctcaaaaaaaaaaaaagaagaaaacaatccagtcaatattgtccaccataaaatttcttctgtcaaccatgctttagtcctggcagttctctgccagtgagtttcagtcaaaaagtttatttataattctttttttttttttttttttaaattttgaaatttggaaacagcatcataaatgatggttagttttctgcagctgcctattttggcagatagtccattgttactcataattaatttgaactaaaagtagtgttgtacgatatcatgggctgtgaatgtgtttgcgacttgatctaagaacccacacaccacttaggatgtttttgtaggaaaattagagtatggaactcacttgtccacgctttccctgtctcagtccattttggtaggctgcaaagtctggggctagaaggacactgaacaagacttcagcagtacgtgttagtcttccagagggaatgaatgtaatagttgaggaaataatttctttcctttgtggctttatgcaaattcctggctatactgttatttatttgggccaaacaataatatcaggtggttgtacattttattgttaattactacgatacattgattttatccatgggtttagcctagcctaccttttgctgttaggcttcaactctacttgtgttgggtaacccctctgcttaaaaatcaccctattcccaagcctgagggagtcttctccacagctttctatgacctaatccaaggcctggcaaacttcataaagggccagatagtaaatttgtgttttgttttgttttgtgttgttttgagatggagttttgctcttgttgcctaggctggagtgcattggtgccatcttggcccactgcagcctctgcctcccgggttcaagcgattctcctgcctcagcctctcaagtagctggggttataggcatgtgccaccatgctcgactgatttttttttgtatttaatagagatggggttgattcaccattttggtcaggctggtctcaaactcctgacctcagatgatccacctgcctcagcctcccaaagtgctgggattacaggtgtgaaccaccgtgcccagcccgatagttaatattttaggctttgcaggccatatatagtcccctttttgtgagtgtttgcatgtttttctttacatactttaaaagctcttttttttttggagacagtatcttgctctgttgcccaagctggagtgcagtggtacaatcttgactcactgcagcctctgcctcctggggtcaggcgattctcctgtctcagcttcctgagtagctgggattacaggtgcatgctaccatgcccggctaatttttgtatttttagtaaagatggggtttcgccatgttggccaggctggtctcctgatctcaggtaatctgcccacctccacttcccaaagtactgggattacaggcgtgagccaccgcgcctgacctaaaagctctttacagtgtaaaaaatgttctgagctttaagccatataaaaataggccataggcccatgggcatttgctgacccctggtagaactccattttacctttctgatcatgtttcccattaactcttcaaaaataagacctccatttaaatcaagatggtctccttcctcactgcttgtggaggttcagtgcccagcgtctgcctcttgcttgcttctccatccttgttctgccattcgagatcctcatacttaccctttaagatctagcccaaatcttccatgaaactaattctaataattaaaaaagagttcctggccgggcgcggtggctcaggcctgtaatcccagcactttgggaggccgaggcgggcaaatcacgaggtcaggagatcaagaccatcctggctaacacggtgaaaccccgtctctactaaaaatacaaaaaattagccgggcgaggtggcggcgcctgtggtcccagctactcgggaggctgaggcaggagaatggcgggaacccgggaggcggagcttgcagtgagccgagattgcatcactgcactctagcctgggccacagagcaagactccgtctcacaaaaaaaaaatacaaaaattagccgagcgtggtggtgtgcacctatagtcccagctactagggaggctgaggcaggagaatcacttgaatccgggaggcagaagttgcagtgagatgtattgtgccactgaactccagcctggttgacagagtaagactccttctcaaaaaaataatagagagaaagagagaaagagagaaggagagaaagagagaaggagagaaagaaagagaaagaaagaaagaaagaaagaaagaaagaaagaaagaaagaaagaaagaaagaaagaaagaaagaaagaaaaggaaggaaggaaggaaggaaggaaggaaggaaggaaggaaggaaggaaggaaggaaggaaggaaggaaggaaggaaggaaagaaagaaagagagagacttatacccagaatataaaacgaactcttacaattcaacgatagaaagacaaacaacccaactgaaaaatattcaaaacatttgcacagacatttcaccacagaagatttacaaatggtgactccaccccgagaagatgctcagcaccacttgtcattagggcgacatggactcaaaccacagctacactcctataggacggcgtcatgggctgtgtctccctaaatccataaattgacgtcattagggcgacgtggactcaagccacagctacactcctataggatggcgttatgagctgtgtcccccctaaattcatagtgtgatgccctaacccctccgaatgtgacgatgtttggaggtgggtttttaaagatgtgagtaaggtaaaacgaggttattagggtggaccctaattcaacaggactggtgtccttatgtgaagagattaggacacacagatacgccaaagggaagactagtaaggatacagggagatgtggccacccacgaacccagggagcggcctcaggagctgctgacagcttgatctcagacctcagcctccagtgctgagagaacataaatttccattgttgaagccgcccaagctctggcaatttgttatggcagcctgagctaagaccgatggctagcataagaagacaaagtcaaggatcaagagttggctgccgggcacagtggctcacacttatcatcccagcactttgggaggccgaggtgggtagatcacgaggtcaagagattgagaccagcctggccaacaaggtgaaaccccgtctttactaaaaatacaaaaattagccaggcgtggtggcacgagcctatagtcccagctacttgggcgcctgaggcaggagaatcatttgaacctgggaggggaggttgcaatgagccaagattgcgccactgcactccagcctggcgatagagggagactctgtctcaaaaaaataataataataatatcaagagtcggtgaggatgtggagaaactggagccctcctacactgcagatgggaatgtaatacggtacggccactttggaaaacacactttagcattttctttaaaagttaaatgtcaacttcccatcaaatttggcaattccactcttcagtatctacccaaaagaaataaaagcacacgtccaccacgactggaacgagaatgttcatcacaacattgtaagcagctgacaaactggaaggagttcatgtggacgaatggatgaaacctggataatccatgggttaacagcaataatggccaggcgcagtggctcacacctgtaatcctagtactttgggaggccaagggcagtggatcacctgaggtcaggagttcaagaccagcctggccaacatggtgaaacctcgtctctactaaaaatacaaaaaattatccaggcgtggtggcggcgcctgtagtcccagctactcgggaggctgaggcaggagaatggtgggaacccgggaggcggagcttgcagtgagccgagatcacgccactgcactccagcctgggcaactgagcgaggctccgtctcaaaacaaacaaacaaaaattcctagccctttgaagggcttacaactctaaggggtccacgtgaaagggtcgtgatagatcgagcaagcgtggggaacgtgactgggggctgtatgcatcagctaacagaacagaaagtggtgcaatgcttcctcatacaatgtctggaatttacagataacacaagtagtttaagtcagggatcgatgttactattttcctttaactaccagggctgggtagtggcgccaggctgtctggctatttattttactcttgtttctttttaactttctgctttctttttctcctgtcttataaactaggcaaggagtggggggcagcaggagaagtagtggtctccttcctgaggatgtatgtgtcaggtgtgtttgtgaggtgtgttaggtgtatgtgtgagtgtctgaggtgtgtgtgaggagtggtacgtgtgaggtgtgtgtggcgtgaggcgtgtgtgttcaggtgtgtgtggtgtttctggggtgtgtgtctggcatgtgtcagatgtgtgggggtgtgtctggggacgtgtgtaaggtgtgtatgtccggggtgtgtttcaggtgtgtgtgagatgtgtgatgtgtgtatggtgtgtgtgaggtgcatgtgtctgaggggtgtgtggggtgtgtatgggtggggtgtgtgagttgtatgtgaagggggcctgccccttgtatttctcatcaggtggagacaagagactgagaaaagaaataagacgcaaagtacagagaaagaacagtgggcccaggggaccggcactcagcatacggagggcctgcaccggcgctggtctctgagttccctcagtatttattgattactattttcactatctcagcaaggggagtgcagcaggagaacagggtgatggtggggagaaggtcagcaggaaaacatgtgagcaaaggaatctgcgtcataaataagttcaaggaaaggtactgtgcccggatgtgcacctgggctagatttatgtttctctttacccaaacatctcagtgtagcaaagagtaacaaagcagtatcactgccagcctctcaactccagccatagggcagttttctcctgtctcagaataaaatgaatgctcagcctcacaccgagacattccattcccaggcacatgcaggaaacagaggccttcctcttatctcaaccgcaaaaaggccttcctcttttactaatcctcctcagcacagaccctttacaggtgttgggctgggggacagtaaggtatttccctgccaacgaggccatatttcaggctgtcttagtgaggggaaaccttggacaatatccaggctttcttgggcagaggtccctgtggttttcctcagtgcatcgtgttaatagagaatggagaatggcaatgacttctaccaagcatactgcctgcaaacatactgttaacaaggcacatcctgcacaggcctaaatcccttaaaccttgattcaacacagcacatgtttctgtgagcacagggctggggctgaagttacaggttaagagcatctcaaagcagaacaatttttcttagtagaaatcaaaacggagtttcttctgtcttccttttctccatagacacagtaacagtctgatctctcttcctttcccccacagtatgtgtttctggtgtctactgtcaggtgcgtgggtgtgtccggggtgtgtattggtgcgtctcatatgtgtgaaatgtatgtgtgaagggtgtgtgtgaggtgtcaggtgtgtgggtgtgtctgggttgtgtgtgaggtgtgtgtgtgtcggggtgtgtttcaggtgtgtgtgagatgcatgtgtgatgtgcgtatgtctggtgtgtgtgtctggtgtgtctaaggggtgtgtgtgttgtgtgtttgggtgtgtggtgtgtgtgaaacgtgtgtttcctgtgtgactggtgtcaggtgtgtgtttgggtatgtgaggtgtgtgtctggggtgtgtgaggtgtgtgtgtttgggtgtgtctggtgtgtgtgtttgggtgtgtctggtgtgtgtgaactgtatgtgtcaagggcatgtgtgaggtgtgagttgggagtgtgtttcagatgtgtgtgtaagaggtgtgtgtgatgtgtgtatggtgtgtgtctggtgtgtctgaggggtgtgtgaggtgtgtgtgaagtgtgtgtttgggtatgtctggtgtgtgaggtgtgtatttctggggtgtgtgtcaggtatgtggagtgtgggtcaggtgtgtgtatgtcaggtgtgtggtgtgtgggtcaagggtgtgtgaggtgtgtttgggtgtgtctggtgtgtgtttctggggtatgtgtcaggtgggcatcaggtgtgtggggggcatgtgtgggtgtgtcagctgtttaaggtgtgtgtttctggggtatcaggtgtgtgtgtggtatatatgaggtgtgtgtgtggatgtgtctggtgtgtgaggtgtgtttctggggtatgtgtcaggtgtgtgtgtctggggtgtgtgtgaggtgtgtgtctgggtgtgaggtgtgtgtttagatgtatttggtgtttgaggggtgtgtttctgggggtgtgtcaggtgtgtgtctggggtgtgtgtgcctggggtgtgtgtttggatgtgtctggtgtttgaggtgtgtgtcaggtgtgtgtcagatgtatctggtgtgtggggtgtctgtgaggtgtgtgggatgcgtgtgaggtgtgtgggtggatgtttctggtgtttgaggtgtggtttctgggggtgtgtcaggtgtgtgtgtgaggtgtgtggtgaggaccaggcagggtccgaggggcgcatgcgcagctccctagcaggggcggtggggggggtgggggggtgcagggccagagcccaggccccgcctccagccgcgtttccatggcgaccgcagcctccgtctcgccgctgcagcccccgccccgcccggctgcgaagcgtctggaaccgcatcctccgcatccacatccgcaccgtcgtcctccccgaccgcgtcctgcagcagctgccagtggagccgcctgtgagctatttccacatttctccttgcagagtgggggcggggggcccgagtgggtgcgggggtgcgaggcgcgtgtgcggcagtgtgcgaggtgcgtgtgctcgcaagtgcgcttgtgcgtggcgcgcgtgcggatgagggtgtgagtgtgcgtgtgtgcgaggcgcgtgtgcggatgcgagtgtgcagggcgcgctgcacggccggccccctcccgcgggcctcctctggttgtcccaggccaggccgaccccgcggacccgaggcagtggtctccaggcttcccgtgacggcggggccccggcacgagggtcgcagcctgcagttcagggtgtctccgaggtgggcagggggtgccagttccagctcctgcccagctctgtctgccgggggcggggtggggcgggcggcagaaggggcggcggaccagagcaccgaggagcggctgcccgcacggtggtgcggggtggggggtggtcttgatgggggcgtctgcgtgacaggcaggaagcggccagaaggccgggaggggcgcggctccggaaccacctgcaacaggcgcgggtgcggggccacaggtggctggagagggagtggaagcggaagcagctgcgcgcccactcccctccgcggggctgcgccggccccgcagtgcagctgcctttgaatcagccgggcagccacggccgcctgcagcgccaggggcaggaggctgcggtggcgcccgtgggggaggggcgggaccctcagggatccgcagtcacacgctcttgtgccccccacataagcccacctgcgcgcacccccagcgtgacgcagcattccaggttggggggcgcatgcgaaagcgagtctgtgacgtgacctccagccgagcttccgtggactttcgactgagagcctgcacccccgcccccgccatccatctgtccatccacacggcctcgctcacccgcgcccccacccatctgccgtcagcatcccacgcctccccttgccccagagacaggagctgggcactgcctccctgccagaacgcggcgggtggggcgcaggggacccgcagaagatgccgccacagcgcaggtgcagggaggggccgggaggaggagcagaggcggccccctagttccacgagccgcgtgccttccgtgggaggaggcccccatgacgcagcagtgcaaagggacggtctggtgtgtggggtgggagggttggaccccacacacaggccagtcccccgttccaaccccgcattccgcctggggcgctgggcctggaaccagaagcgaggctccagtgggcccccaacggctttttcttcctgaagacgcctctcggcctgtctccgttgccacgcacacccgcgatgacgtaaagtggccgtccgaggagttggagttgaagtttggctcgaaggggaccccagaagcgaagctcctcctggcggggtcctgacccctggcgccggccccccggggcgtggctctaccctgtggcgctgcgggccgtgactgcgccccctctccgcccccctcccgtctgtacagaggctgggcttgctctgggagtccgctgcggggagacccctgacccctcctcctcggtggtacccccacccccgcgggccaagctccacctcaagccccggcgctcgccgccctcgccccacgaccacgtcattccccggcctcttggccctcggctgctccaactccgcttccatggatcacttctgtatttaagccccgtagggcctcgtccgtctccacctgcacacacacggacgctggctgcaccgtgaaacctcgtccgccgagcgcccattgcccctgcctgggccacgtggggacccacctcaggcagagtctccagcccagggtgggtgttcgggggaccctgcacggcctcttccggaaaggcccggccgggcacagggtcgcctgtgatgaacgcccagcaaggggcacgggttagggccccagagcgcgtggtcaggtccaggactggggaccctgtctccgctcatccagctccttccggctcagagtggcctccctcatctcctatccagccctcgctttccagtctcactcccgcccacgcagatcctttccccctctggtccttcctcctcagttctttccacaggcagaatctgccacctccaaatccttccccctctgatccttccccttcagatccttcccccctcatatccttccccctcagatcctttcccccctcagatccttcccccctcagatccttgatcctttcctctcatgcccttcccccccatgcccttccccttcagatccttccccctcagatccttccccctcagatccttccccttcagatccttcccccctcatatccttccccctcatatctttccccctcagatcctttcccccctcagatcctttcccctcatgcccttcccccccatgcccttccccttcagatccttccccctcagatccttccccttcaggccctggccctcagatccttccccttcagatccttccccctccgatccttcagagctttcaccttcagagcctgcccgcctcagatccttccccactctgatcattccgctttcagatccttccctctcaggtctttccacacctctcagattctttcaccctcaggtctttccccctgagacccttccccttcatatccttcccgcctcagagccttccactcagatcattccgccgtcaggtccttgcttatcagagccttccccatcacatccttccaccttcagattcttccccaggcgaaagttgccaccttctaacctttttgccctcgagtccttccccctcagatctttccactctcagatccttcgcccttagacccttcccccttaggtccttccccttcatatcctttcccgctcagaactttccactcacggatcattccgccctcagatttttccccctcagatcctttccccctcaaatccttccccgttcagatttttctgcccacagagctttcccgcctcagagccttccactctnnnnnnnnnngtatttttagtagaaatggggtttcaccatattggtgaagctggtcttgaactcctgacttcgtgatttgcctgccccaacctcccgaagtgctgggattacaagcgtgagccaccgcacctggcctgtttctggaatgttaataatcttgttgtcatttcaacagtgctcacagcagcttcaacaggtgtagattccatcttaagaaaccactttctttgcttatccataagaagcaactcctcatctattcaagttttatcatgagattgcagcaattcagttatatcttctgaccccacttctaattttagttctcttgcttttttttttaccacatctgcggttacttgctctactgacgtcttgaaccccgcaaaatcattcatgatgattataagcaatttcctggctgggcacagtggctcacgtctgtaatcccagtactttgggaggccaaggagggcagatcagctgaagttaggagttcaagaccagtcagacaaacgtcgtgaaaccccgtctctactaagaatacaaaaattaggcaggcatggtggcgggaacctataatcccagctactcgggagactgaggcaggagaatcgcttaaacctgagaggcggaggttgcactccagcctgggcaacaggagcgaaactccacctttaaaaaaacaaacaaacaaacaaacaatttcctctaaaactctgctaatattgatgttttaacctcctcccatgctcatggatggcattttccttggcatctagaatggtgaatacttttcagaaagttttcaatttattttgcccagatccatcagagaatgactatgaatggcaacagtaaccttacagaatatctttctgtctttctctctttctctttctccctctctctttctgtccctctctctctctgtctctctttctctctttctctcctcccctccgcccccctttttttgagacggagtctcgctctgtcccccaggctggagtgcagtgacgccatctcagctcactgtaagctctgcctcccgggttcacaccattcttctgcctcagcctcccgagtagctgggactacaggtgcccgccaccatgcccagctaagtttttgtatttttagtagagacggggtttcactctgttagccagggtggtctcgatctcctgacctcgtgatccgcccgcctcggcctcccaaagtgctgggattacaggtgtgagccaccacgcccagccccctccccttctttttgaggcagcatctcactctctgttgtccatactggagtgcggtggcatgatctcagctcaccgcaacctccgcctcttgggctcaagtgacttgggagtagctgggattacaggcgcccaccaccacttctggctaatttttgtatttttagtagagatggggtttcacgatgtgggccaggctggtcttgaactcctggcctcaagtgatccacctgccttggcctcccaaagtgctgggattatatgtgtgagccactacgcctggcctaattgacctaatttcaatattgttgagtctcagggaatagagaggcacgaggagaaaggagagagacaagctgactgctggttcgtggagtagtcataacacacagcatttattaagattgctgtcttatatggacagtttgtggtgccttaaaacaaatcagggtaatgtcaacgattactgattgcagattagagattactataacagatacaataataattgtaaattattatttacaattattgtaaaatacaatctgtattctaacaggtacaattgtaaagtattacaattgggcaaagtttgataatattgtgagatttatgaaaatgtggcacagtcgcaaagaaggcacatgttactggaaatacggcactaatggacttgcccgactctaggtttccacagactttcagcttgtcaaaaatgcagcatctgtgaatttcaataaagcaaagcagaataaaatgaggtgtgcatgtattgccatcatatgtacactagtaaaataccgttttttcttcagtaggtggatcaacctcaaattttaatatgaagcattactttttttttttttttttttttgagacggagtctcgctctgtcgcctaggctggagtgcagtggcaggatctcagctcactgcaagctccgcctcccgggttcacgccattctcctgcctcagcctcccgagtagctgagactacaggcgcccgccacctcgcccggctagctttctgtattttttagtagagacggggtttcatcctgtcagccaggatggtgtcgatctcctaaccttgtgatccgcccgtctcggcctcccaaagtgctgggattacaggcttgagccaccgcgcccggccatgaagcattacttaaatgagaacatggggactttcatgacatttcttacttgtgtgtgcattaaatttccatgaaaataatttaatgctatccagcagtttattttagaagtaagtactggaggctaggcatggtggctcatgcctgtaatcccagcactttgggaggctgaggtaggaggatcacttgagttcaggagctggagaccagcttgggcaatgtagtgcgaccccgtctctacaaaagagaaaagaagtactagagtgttacagctcttacagagtttgtctagcaggttttccagtctttaccagaaatgcccccatgcagaagtagtaaatactgattcatgtaaaataataaacaactttatctttcatttttttaaaaaaagggtcttgtaatgttgcccagactggcctttaattcctgggctcaagcgatcctctcatctgagccttgtgagtagctgagactacaggctgcactactgcacctggctctgcttgatttttaattgttgtgttgctgttgcagctatggtttctttttttttttttcttcagtgcaaggatgggcaaactttttatgtaaagtctcagataataagtattttaggctttaaggccatataacttctctgttgcatatccttttttctttaaacaatccttactattttttttcttccatttcccctcaaattccttttaccataagcaactcttgaataacttaaaaatcattcttagtccagaagccagaccaaaacaggttgtgggctgtagtttcctgacccctgacttaaagattgattgctttgaaatggaaagttgtgggggtttttttgagatgaagtctcactctgtcgcccaggctggagtgcagtggcacgatctcggctcactgcaagctctgcctcttgggttcacgccattctcctacctcagcctcccaagtagctgggactacaggcatctgccaccacgcccggctaattttttgtttttttagtagagacggggtttcactatgttacccaggatggtctcaatctcctgacttcgtgatccacccgcttcagcctcccaaagtgctgggattacaggcgtgaaccaccacgcctggcctgaaatggaaagtttttaactttcttctttttttctttcccctgttctgattgggctgttaattcattggatatttactgagtgtatgtcatatgaggcatgattcctctgctaattttggtagtggtagaaagatactttcgccaagcttggttgttcaggttttcatttgtccaagagttcctgaccaagtgtaaatggatgttgaaatcaagttgtttctttggccacacaatgtgcctttgtggctatatctatgtgcttctggtgcctccttttaattttcacaaagacactgcttgccaaccacactgttttccctaatgtggggctatgaccccctggaagaggcatcattttctgattttcacagaagcataatacggtcaggtgatggtcctgagtagtgggcatatgacagatacactggtaattataatacagatctaaactggagagttgaaaacagcattgtgtatttgattgagataatctaaggaaggcttcctgaaaagatggcatttgagtttcaaggctgagtaggattaagtattattacttaaaaaatgtgttggacagtgcactaagtagagttaacaagtcatatcacttacagtttccaattaaaaatattttgcttacacataattttagacttttagaaaaattgcaaagatactacaaataattctcatatatttcacctacattcttcaagtaacattttaccatattcacctttacgttttctctgtattggtatttgtatatataaggtttaatgtaaaataaaaattaccttattaaacatatgagagacatgatgcttctttagccctaaatacttcaaattgtatttcctaataacaagggcattctatttcaaaaccacagtacagtttaaggagattaatatgtgtcaaactgttatgctgtttacagaccttttcttctaatgtcctttaaaacagtcaacaaatcaacatttttttctggtccgagaaccagtaaatacatatattctacatatatgtatatgcgctatgtgtacatatatatgtattctatatatctgtattttacatatatatgtacctatatatatgtagaatatatatatttactccccctgtccaagaaccaatccaggattgttaccttcagttatcgtgtatctttggtctcctttaatccatagcagttcctttgtcttttatgacttgacacttttgaagattataggttattttgtagactgtctctcaattagggtttattttaggtttccttatcattagattcagatatttatttttggcaggaatacaacagaaatgatttgtgtgtttttctcattgcatgatatcagaaagtgcattatatatatttgtcccattactggggttgttaactttgatcacttggttagggttgtgtctactaagtttcttcactataaagttatttttcactttgtcatttcatcagtatcttgtggggagttactttgtggttatataaatactctgtttctactttcccttactatatttagcgtctatgaacactttgcctgaaacagttatttactatggtgttaccaagtggtgatgcccctttcttccatcactctgtgtacatttttttttttttgagacggagtttccctcttattgcccaggctggagtgcagtggcgcaatctcagctcattgcaacctctgccccaccaggttcaagcaattctgcgtcagcctcctgagtagctgggattacaagcatgtgccacctcgcccggctaattttgtatttttagtagagatgagatttctccatgttggtcaggctggtctcgaactcctgacctcaggtgatccgcccgcctgagccttccaaagtgctgggattacaggcgtgagccaccacaccaggcctcctttttctcttttttaagagatagagtcctttgtcatcaaggctagagtgcagtggcatgatgatagttcactgcagcctcaaactcctgggctcaagtgaacctcccacctgtagctgggactacagacacccacataacacctgactgttttttaaaactgtgttagagatggagacttgcgaagttgattgggatggtcttgaactctgagtctcaagtggtccttctgcctcagtctttggattagttggcattacaggcgtgagccattgtacctggcaagtgaatattttctttctttttttttttaagatggaatctggaggccgggcatggtggttacacttgtaatcccagcactttgggagactgaggtgggtggatcaaaaggtcaggagattgagactatcctggctagcatggtgaaaccttgtctctactaaaaatacaaaaaattaactgggcgtggtggcatacgcctgtagtcccagctacttgggaggctgaggcaggagaatcgcttgaacactggaggtggaggttgcagtgagtcgagatcacggcactgcactccagcctgagcgacagagggagattctgtctcaaaacaaaaacaaaaacaaaaacaaaaatggagtcttgctctgtcgcccagcctgcaatgcagtggcatgatctttgcctctgagttcaagtgattcttgtgcctcagcctcctgagtagctgggattatagacatgtgccaccatacgtggctaatttttgtagttttagtagagatggagttttgccgtgttggccaggctggtcttgaactcctgaccttaggtgatccacctgccttggcctcttgaagtgctgggattacagatgtgagccactgcgcctggccaagtgaatatttgctaatgtagcattttttatgattttttttttttttttttttgagatggagttttgctcttgttgcccaggctggagtgcagtggcacgaccttggctcactgcaacctccacctcctgggttcaacagttctcctgcctcagcctcccgaatagttgggattacaggcgtccgctaccacacctggctgtttttgtatttttagtaatgatggagtttcagcatgttggccaggctggtcttgaactcctgacctcaggtgatccacctgccttggccttccaaagtgctgggattaaggcgtgagccaccatgcccggccagagactgttcttttttttttttttctttgaaggcagagtctcgctctgttgcccaggctggagtgcagtggcgtgatctcgactcactgcaagctctgcttcctgttttcacaccattctcctgccttagcctcccaagtagctggggctacaggtgcccaccaccacgcctggctaattttgtttttgtgtttttagtagagatgaggtttcaccgtgttagccaggatggtctccatctcctgacctcgtgatccacccgtcttggcctcccaaggtgctaggattacaggcgtgagcctctgcacccgaccgagactgttcatttttattcatactttattccctctgttctttggattgcataatctgtctcagtctgcaaaattgttatttcgtcagttcaaatctgtttagttctctagtgaatttttcattttagttagtgtattttcaacttgacttccatttggtttctttaaaataatttctctttattaatattctttatttgatgcaatatgataatcatatcttttttttttttggatggagtcttgctctgtcatccaggctggatcttggctccctgcaacctctgcttcgtggattcaagcgattctcctgcctcagcctcccaagtagctgggacaacaggtgcatgtcaccacacccagctaatttttgtatttttagtagagactgggtttcaccgtgttagccaagatggtctcaatctcctgaccttgtgatcagcccaccttgaccttccagcgtgctgggattacaggcatgagtcactgtgcctggccaatcataccttcttttactgcattaattatggttttctttcgttctttaaacctgtttatagtgaccacttttgaagttcttactaaatcagacatctggttatacaagcaatttctattgcctacttttttttccagtgggtggggttatactttcctgtgtcttagcttgtcttgtcattttttgttgaaaactggacattttgaataatgtagtaactctggatactggtcctcattagcctatggttggggggggtggttgttactgttatttgcttatttgtctaatgactggctgaatgattttagtgttctatccttcttccctccccgtacagtgtgacgcatctgatgctgcttttcttgggatgcagccttgggtatgcctaccatcattctggaatcacagtgattttggcatggctttgtctcttttcccgactgtacccagctgttaagctacactaattactagatgatgctatagagtcatttcttggtgtccttgggggattggtcccaggacccccctgttggatataaaaatttatggatgctctagtccctcataaaatggcacagtatttgcatatacctgtgcacatcctcctgtatactttgtcatttttagattacttgtagtacctaatatggtgtaaatactaggtaaatagttgttatatattttttatgtgtttgtttttatcgtatttatttttaagtgtttttcatctcgagtggttgaatctgagggtgtgagatcctcagatgtggagggcctgcattgtttttcagtgatgctttggggcataaactgctccacagactgatctgatcaaattttagcttctttgaagggatagtttctgagatcagtgttttaaatttgttctgatccacggaggagtcctcccagctctctttccctagttttggcaagctacaatttagcacttatctccagtgattctaccaatctcctcctaccaagtgcctttgaaagcatcatgaactctttcataccttgttgcaaatgaaatttctttgggaagagattgtgagtttttttctcctaaattttggtacaatatatgtaatacaccatttcaacaattttaagcgcattaagttttttttttttttttgagatggagtctcgctctgtcgcccaggctggagttcagtggcctaatcttggctcactggaacctccacttcccaggttaaagtgattctcctgtctcagcctccccaagtatctgggattacaggtgcgtgccaccacgcccagctaatttttgtgtttttagtagaaacggggtttcaccatgttggtcaggctggtctcgaactcctgaccttgtgatccacccacctcggctttccaaagtgctgggattacaggcctgagccatgacgcccagcttatgtattgcttttatatgtattttaaaatttataagttctcctcctatggtgtttttgtactacgtgatttatttgttgtttttttttgtttgtttgttttttgtttgtttgtttttgttttttttttttttgagatggagtctcgctctgtcgcccaggctggagtgcagcggccagatctcagctcactgcaagctccgcctcccgggttcacgccattctcctgcctcagcctcccaagtagctgggactacaacctcgcccggctagttttttgtattttttttttagtagagacggggtttcaccgtgttagccaggatggtctcgatctcctgacctcgtgatccacctgtctcggcctcccaaagtgctgggattacaggcttgagccaccgcgcccggccgatttatttgttaaactgtcatctttggccgggcgtggtagctcatgcctgtaatcccagcactttgggaggctgagacgagtggaccacaaggttaagagatcgagaccatcctggccaacatggtgaaaccctgtctctactaaaaatacaaaaatatctgggcatggtggcgctcgcctgtagtcatagctacttggaggctgaggcaggagaatcgcttgaacccaggaggcggaggttgcagtgagccaaattgtgctactgcactccagcctggcaacagagtgagactctgtctcagaaaataaaaaaaaaaaaaaaaaaagaaaaactgtcattttttatgttgcatttactacattctggatttaaactgtgagtaacctcatggtatcagttaatatatccttccatcttaatgtttctcgtaaactggtagtagatccgtaaacttgattaggtctatcctattgtatcacatcagaaggtgggttttttttcttttctttttttttttaagggaaattgtttgaaagtagaatggtaaagtgaacccctgaacacctatcacccagctttaatagttatgagctcataccattcttgtttgatttacaaccccattgatttctcccttctgtattattattatttagttacttattttttgagacagggttttgctctgtcacccatgctggagtgcagtggcatgatcacagctcactgcagtcttgacctcctgggctcaagtgatcctcccacctctccctaccgagtagcggggaccacaggcttgtgccaccacacatggctaattttttattttttgtagaaacggggtcttgctttgttgcccagactgatctcaaactcctgcactcaagtaatcctcctgcctcagcctcccaaagtcctgggattacaagcatgagctaccacattcagcatgtaaatttctttatattaatttgactgacattttaagtcacacttgaatttcatattcggcaactattgaaagcatagagtcctggatattagtgttttgttaaacttgatctatctaaccataaatatacttaggtctaaaatgtgctcttggcctttttttattgcaattcagtatttgtttctctattaaatagtaaaatacttggtttgagatattaatgaaaagattaaaagtgaagcataacttgaagggatacaaaaagaaacaagaatttagactttaatggatttcagagaatactgcttcgatatgctaacattcttcttgggtgtccaaccatgtcatagatcagtggaaatcagtggtttctgtattctgtactgttttttatatgataatactttcctggttgaatgatatgttctgttgagtaaactccatggtcaaacaattactttttattagttaaagatgtaaccacataatcactaaaaagaacaatgtgacttatttaaaggggattatgtttttaagtcttttatatagctttgtagggaggccatatgaatttaaggacagttcgtggcatttgttcaaggttttgtaacttggcatctcagcaaccaccaggataccagatcatccttctaagtaagatttaggcttttttgccttcatgtacaggctataagtaaccacccgctaccccccactaaagccatgaattcaaatgatgtttgaaaaagtacagaatttctgttagatgaggtagtttattccttgtgatacagtttcaaagaggcagcataacctagaaatgaaaaacttagacatggaatcagatatacctggtttaaataccagctctactgcgcatgaattggatgattttggtcaagatatttgattggtaaggctcagtttcctcacctgtaaggtagaggtgatagattagacatgttccatgtgaggtacttagtatggtgtctttttttgtagtgagatctatgaaagataaattattagtcgtattccttagacttcagaagtttatctctgtgccatgtttgaggcaaacagttacagaattagaacgttagaaatgaaaggaatcctagatatcatttgattcaagtcattgttttctggatgagagaagaaagtaaggaaagtgacagagttggagaccaagctgggactggccttcagaatgtttagagtactcttccaggaatggaccagtcatattactagactttttggaccctgaattgtgcttttccttgaatgttttgaattttggtttgagtgctgtgattattttattaaaacaagattccagtcctattgtcatgactaatgtttatgagaaatgtaacatttcactttaacggtgtttttaaattattctaagggccctaatctttttcagtggaataagctttaggttgtattatattctgtaattcacataaaaatagagttcatctttacttgacagccgaattttgtgtactgcatcttttctgagggagagagttggcaaggaaaggcacttgttataacaatccacacatatagacacatattatttagaaatgaaagtgctttgaatgatttagcttattttcagttttttttttttttcccctgcggttgtaatcatatgacctgtttttcttgtttgggttttttttttttttttttttttttttgagacacagtcttgctctgtcacccaggctggagtgcaatggggcggtctcagctcactgcaacctctgcctcccaggttcaagtgattcttctgcctcagcctccctagtagctggaactacaggcacatgccaccacacccagctaattttttgattttagtaaagatgggatttcactgtgttagccaggatggtcttgaactcccgacctcgtgatctgcccatcttggcctcccaaagtactgggattacaggcatgagccaccgtgcccagcctgtttctcttttatagatgggggagaaatatgggaagtggcttggtgtcagtcatctgtgttagttaaatcaaaaatataatctgtattttgcttcggagtagctctttataacagtgattggctactttgggagtaaagattattatttagagacagggtcttgctttgttgcccaggctagactgcagtggaatgatcatagcccactgcagcctcaaactcctggactctggtgttcctgcctcagcctcctgagtagctaggactagaggtgcatgtcaccatgcctggctatgattattattaatttgcgtttaacattagtttttttcttccagtaggctattttactttatttatttgattttgataaagtttgattatttctagtttccttccttctatgacccctacccattctgagtctccagacaagcagtgcacaggtagagccatccttaggtaacctttagacttaatattaggtgagctcttcccacagatagcctctcctttatttgaatggaattatattttaagtttggaaatatttttcagcttatttagcctgttgaatttaataaaaataatatttaatcttttcagaggtcgaaacagtaacaaaggactgcctcagtctacggtgagtaactttaatgttacttattggggaaaattagtagctaaaacatgatctctaaccacagaccaaatgccaaggcaaaaaattcccttctcttgaattttatcacagataacttgactgtttaagtatatgattattagcctacatgtgtgtttttttttttaatgattctatgcataaaatgtaaaattatttgttgtattagtccattctcacagtgctaataaagatatacccaagactgggtaacttataaaggaaagaggtttaattgactcatgctctgcattgctggggaggcctcaggaagcttacaatcatggtggaaggggaagcaaacacatccttcttcacatagcgggaagagagagaagtgctgagcaaagcagggaaagccccttataaaaccatcagatctcctgagaactcactatcatgagagcagcataggggaaactgctcccatgattcagttatctccacctggtcctgcccttgacacatgagaattattaaaattcaagataagatttgggtggggacacagaaccaaaccatatcatttgtaaatagtatttttttcatgcgtaataataagaacaagtcatttgttcttttctaaatgactaagtgcaaatctaagtgaaaaacctccaagatacatgttatgaacaccaagagtggagtctgcagagttctttatgctttttattttgaattaatgtgctttttttctgctgctttcatttttctactttggctttctggtcctaaattttggaatgttaccaatgaaattgaactggacctaaagggcagacggtataagttccatgtaatggaagaaataaatgagaagctattacacatttttgagacgttgcctttattagacagattgttttacaagagtcaggaagatacacacgtatatagtagtaatatggaatagtgtggttgatcagacttaagcactgtcattgatgcagatatgctgggagaacctagtcagggtttttctgtgaaggtatgacctggcttcctaccccgtttatttatactttacccttcttagggtatatttctgtgagttttaacaaatccatacaatcagtgtaactaccaccacaatcaagataatagaacagtttcattgcccaccaaaatccctcaaatcactttttagtgaaccctcctctccaaccattgatttgtcttccatccttatggtttgtgtccttcctcctttatggaagttgacttttgcttttttatatcacgtttagtcaaaatatcgttagttggtatgactgataacacttgaaaacctgaccttctgttccttctgttctctacagaagcagagtattaaataaacagaatcttcctttaatacacgtaagatatcataaacctaactaaacattttgcaacaaaataaacattaactttatatgcaagtgtaaatacaggctgaatatccctaatcagaaatgctctagaatttcacattttgaattagggatgttcaagcactaagtataatgcagtatccccaaatccgaaaaaatccacagtttgaaatacttctggtcccaagcattttagataagggagattcaatttgtactaatttctaatagtcttttttttttttttttaatattccagatttcttttgacggaatctatgcaaatatgaggatggttcatatacttacatcagttgttgtaagttattagattattggggataaactgccttgggggtagaataaagtaattccatgaagttaaaatatggataaatgattgtcaaagtaacattgcttagatcatgtttagtcaggatgatttagagaaataggttagaactccctttatccagtctaatcattgtaacagtacagttggtcctctgcatctgtgagttccatatttatgaattcagccaaccttggatcaaaaatatttgataaaaaggccaggcacagtgactcacgcctataatcccagcacttcgggagttcgaggtgggcagatcgcttgagctcaggagtttaagaccagcctgggcaacacggcagaactccgtctctacaaaaagtaaaaaaactagccgagcttggtggtgcgtgcctgtagtccctgtgacttgggaggctgacgtgggaggattgtttgagcctgggagatggaggtttcagtgagctaagatcatgcccctgcactcagcctgagcaacagtgccagattccttctcaaaaaaaaaaaaaataaataaataaatttttttttctttttttgagaaaaaagatgcaaggtcgcatctgaaccaaagatgtacagatgtttttcttgtcattattcccaaaacaatacagtatgacaatttacatatcatttatattatattagatattataagtaatatagggataaagtatttgggagaatgtgcttagttatatgcaaatactattacattttatgtaagtgacttaagtataatgtaattcggtatctgaaggaggtcctggaaccattcccctaccaataacaacagacaactgtattcttgttaaccctgcggtgtgtgtaaaatagtattagtagttgattgtcttttgtacattattttgtcaaaatagctggggtcagacatgtttggcttcagtattaaaattcgtactgcaagctctgagtagagcctcctgaagaatttcgagagttcagtgtattgttaatgttttgaaatttttgtattgttttgttagtgaatacctaatattgaaggaagcctgatgaggtataaaaagtaaaatgaaaacaattatccctggtgaccagataatatactgtttctttgataaattaattatatgtttttagggctccaaatgtgaagtacaagtgaaaaatggaggtatatatgaaggagtttttaaaacctacagtccgaaggtaatttttacttttttttctttttcttacaaagtaaaagaacatattcatagtcagtgctttacctagtttttaaagccactttgaatgattttactcctcagtttcaaatactgattattttatagactggtttgtgtaatcagaaagacttcttgatgtgtgtgcttattaaaatatttcaatcacttttaagcattgtgaactaatagagggatgtagtggtttattttttcctcttaaaaaattattattaatgtacttaagacaaaccatagcaacaaaaaacatttagaagtgaggattttttaaatgatggataataaatcatattcgttggaaaaaggatgtgattatcaggttctcttgagattatttttgtcaaaggcatataagaactggtaccttgatgagctaaagaattcctaacaaatgttattttgtaaatgttttgaatacttacttgtgtttttcattttagtgtgatttggtacttgatgccgcacatgagaaaagtacagaatccagttcggggccaaaacgtgaagaaataatggagagtatcttgttcaaatgttcagactttgttgtggtacagtttaaagatatggactccagttatgcaaaaagaggtgggttttgatttcctaaatatgcctcatggtttactaaatttattcaagcatagatttccacagtgctgttacaaactttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccacaaccgcgcccggctaattttttgtatttttagtagagacggggtttcaccgtggtctcgatctcctgaccttgtgatccgcccgcctcggcctcccaaagtgctgggattacaaacttttttaaaagaaatatctgggccgggtatggtgnnnnnnnnnnccgtctcagcctcccaaagtgctgggattacaggcttgagccactgcgcccggccgaaaaatgggaattttaatgcatttttgttggaaaaacttttagtactttagagaaaaatagagtttttgtgatctcttaaaaaattagtttgtaaagcattttctacagttttgtggtcaagaatgctactgattatattcaactgaaaattttttgtcccatttgtcctacaatgctttcgtttataagtgggcatgtggcaaatctggaaagaaatcaaagcatagagctaaggaagaaaggtagagaacggctggtagaaaacagttgtctaatgaaaatgaaaaagggtaaagaagtagaacatgtatatttaaaaaatagaatatgaggcaagattttgagaatttaaaagcgattatgtggttatattaaaaatttagtctcttttttaagtgtccattgacgaacaaagtgggaattcctgttactcatttgcagagcattattgaatgttcagtaacatattgcaaggcacttctgggcaatcctgaacttggttctcaaattcttttttttttttttgagacggagtcttgctctgtccccaggttggagtgcagtggcgcgatctcagctcactgcaatctctgcctcccgggttcaagcgattcttctgcctcaacctcctgagtagttgggactacaggagtgtgccaccacaccaagctaatttttgtattttttttagagacggggtttcaccatgttggccaggatggtctcgatcgcttgaccgcatgatccgcccgtctcggccttccaaagtgctggaattacaggcatgagccactgcacccagccggttctaaaattcttttatttatttgtatatgccaaattctgtagtgaaatatgtaattctgttgtaaattgtaaatcagtgcaatttgattttcagtattcaaatctataccaagagctgttttttgttgggctgattcttctacactgttacatggaaataataatataccaggattctttttcttagacttaggagtctttctcttggcttgctttttcagaggctaacagtactgggtattctttaactgtcttgatatgctgatgaaagcacagtgttctgtttttgaatcttctcaaatgtccttgtctttgattcacaactctttgttttaagaggccttcagcatcctatacaaataaacaagtctttttttagcagctacctttgcagttgatttttgtttatgcctatgagtactaaattatttatacttatactattgaaatattccactgttataaattcaaaaattgattttggcagataaaattttagttgaatttaatacataacactctagaaagagtattggccgcaacaaaaaaaaaggttccttactctgttgggtatcaggtcatttaatagccatttacagtatgcattgtctttttgtttttatgatgaattggcatttcccaaatgtggaagactgaatattactttgagatgtttgtgatggtccattccttgctcctcttcaaaattaatgtcattaaatttttattactttatgtctttatttctcagataattttagttcattatagaaaggcaagaaaatacagatcagagtgacaacttagaaaatctcactatactcataaggggatgggtatattttgctatatattacagaattagttttcttgatgaggacatctactattggagtaatttcaggtattttatttcttcttttctttctttcttttctttttttttttttttgagatggagtttcgctctgttgcctaggctggagtgcagtggcctaatctcaactcaccacaacctccacctcccaggttcaagcgattctcctgcctcagcctcccaagtagctggtactagaggtgtgtgccaccgtgcctggctaatttttgtatttttaatagagagggggtttcactatgttggccaggctggtcttgaactcctgatctcgagatccacctgccttggcctcccaaagtgctgggattacaggtgtgaaccaccacgcctggccaggtatcttatttcaaaacttagagtgctttagtgaattatacagttgtgtccagtgtatagtatcctgaaaatagtattaagtcatgtgtttaggacttttcaggtctcttaagctaagttaagactatccaggcagaaattgctctcttctataaaagaagaaaagtattaatttggaagtacaatcagtatggataaatctgttttagagttattaattggcatgattttctctctctctttttttttttttcgagatggaatcttattctgttgcccaggctggagtgcagtggcgcaatctcggctcactgcaacctctgcctcctgggtttaagcgattctcctgcctcagcctcccaagtagctgggattataggcacatgccaccacgccctgctaatttttgtgtgtgtgtgtgttcttagtacagacagggttttgccatgttggccaggctgcatggtttcattaataacaaaaggcatttagtactgcatctggatttttattattttgtgttagagacttactcagattactcccaaagtaaaggaaggtatggcttaatcagtgcttcttaatgctaggttcacgtttagtcacgtggggagtttttaaaaatgttttcacttctaaagatcttggtttaattataattagcctgggtgaggctctgggcagtcaagggtgtgagctatggccttcatgtgatgagatcccaggagtggctctgttttgtggccttgagaatttgtgctttctaggccaggtgcggtggctcacgcctgtatctcactttgggaggccaaggtgggcagatcatttgaggtcaggagttcgagaccagcctggccaacgtggtgaaaccccatctctactaaaaaattaaaaaattagctgggcatgatggcacatgtctataatcccagctactcaggggcaggctgtggcagaagaattgcttgaacctgggaggcagagattgtgagatcgcgccactgcactccagcccaggcaacagaataaaaaaagaatttgtgcttttttttcttgcctcacagtcccttttctgtctcagaatcggcaactgcctgaaatagtctctgctgttatcatttggtagtacttttctacatcttgaatggatagatggattgagtgttttttataatagaagtgggtgaatgattagagtatactaatatgacattgtagtttcctaaaagttaggaattgatttcgtttctgagcttttatcttataattctcttctgtaatagtgctgttagattcttaaggttgataatattactacaatttgagtgcatattctatgtgccagactctgtgctaacagatttgcctacacttgttcacgtaatcatcacaacttgtttccgtagcaggtacagctattatccacatcataaatgaggaaacagaggcatatttaggaaacttgctaaagtgaggacacaaatctagcttttccactctaactcatgttcttaacattatactgcagtgacataagttatgtggtttgttgtttatctcagttgtttgtttgttttgagacggagtcttgctctgttgcctagggtgggtacagtggcatgatcttggcccactgcaacctccgcctcccgggttcaagcgattatcttgcttcagcctccttagtagctgggattacaggcacacaccacccacacctgggtaatttttgtatttttagtagagatggggtttcaccatgttggccagacttatctcaaactcctgaccttaagtgatccgcctgcctgggcttcccaaattactgggattataggcgtgaaccactgtgcccagccaagtaagttgcatggttgttaaaggatttttccacaaataaaactaaaactaaaagtaaaaaaaaaaaaaaaaaaaactcaagaaatacaagatgcagactattatgttgttcaagattttgtgtgtgtgtgtgtgttttaaatctttgactttatttttggggaaacctttttgtttccttttccttgggacagagtttctctcttgttgcccaggctggagtgcaatgatgcaatcttcgctcaccgcaacctccgccttctgggttcaagcgattctcctactttagcctcccgagtagctgggattacaggcatgtgccaccatgcccagctaattttgtatttttagtaaagacagggtttctccatgttggtcaggctggtcttgaactcctgacttcaggtgatccacctgcctaggcctcccaaagtgctgggattacaagtatgagccaccgtgcccggccagggaaacctttattttgagacggagtattgctctgtcgcccaggctggagtgcagtggcatgatcttggctcactgaaacctctgcctcccaggttcaagcgattcttctgcctaagcctctggagtagctgggattataggcgcctgccaccatgccaggctagtttttgtatttttagtggagtcggggtttcaccatattggccaggctggtctcaaactcctgaccttttgattcccccgaccttggcctcccaaagtgctgggattacaggtgtgagccactgcacccggctgctggggaaaccttttctttcttcctttctttcttttttttttttttgagatggagtctcgctctgttgcccaggctggagtgcagtggcgcgatcgcatctcactgcaagctccgcctcctaggttcatgccattctcctgcctcagcctccccagtagctgggactacaggcgcccgccaccacgcctggctaatttttttgtatttttagtagaggcagagtttcaccgtgttagccaggttggtcttgatctgacctcatgatccacccgtctgggcctcccaaagtgctgggattacaggcgtgagccactgctggggaaaccttttaacataagtaaggtcagtgtgacttttaagttcttgatgctaacatcattgatttcaataaagtttaaaagttatgcatatatgcaaatgagtaaaaggcttagaaatagtgacttcttatggtatgatgaataaatttcatttggtctcttgaatgttatacatgtttcagttgatttactgacaaactgaaagtagctttacatcttatgagctgtgagtccccttggcacattcataattagaggagaccatcagattatcattggaaaatcagtttttatttatcctttatttgaattccagtgtagacagatctgagattctcttcattttgccaaaacttatcagccgcttttcgctctgtgttcgtgtacctttggaattgtcctgttatctctgcttgttttttacttgattttccatccatttccagtattcctttctcctctattttttttccttcattttctttctgctcttcctgttgcactattattcatgtttttctcttgactccaactcaactatggctttacttctgttttcttattccattgttcctcatactttttcctactgcttcattttcttagtaggattctcagcctagatgataggggtcagcagatctacccatcagtaaataaattttattgtaacatagctatgcccatgcatttgtgcattatctatggctgttttcatggctgtagccgtagagttgaatagttgtagctgactgtagggcttgcaaagccagaaaatttgactgtctctttacagaaaagtttgccagcccttggcctaaatcatattttccactgcatttagggctatttaggactgatcaaaaatacatgctatactggctttggtgaagtaacacagaacatgttctgtcctttaaacttataactaattgcatgctttgattctaatactatataatatcctgcgattccttattcatgaccattctaattggatttagtctgaagaattactttcgcttaacagattctttgtcacatttagtgaaaaatcatgtaaggaaaaggttggttaatggaaaagatctccatcagctgaccactcccttccttatctacaaatttatcttcctcctccgtgccatcttttttttttttttttttgagatggtcttgctctgttgcccaggctggagtgcagtgatgcaatcacagctcactgcagcctcgacttcccaggctcaggtgatcctctcacctcaacctcctacatagctaagactatatatgcatattactatgcctagctaattttttatatttatattttttgtagagatggagtttccccatgttgcacagggtggtctcaaactgctgggcctaagagtcttccaaaagacttggcctcccaaaatcctgggattacagacatgagtcaccacacctggcctcgttattgtttttcctctgtttttagtagagacgatttttaagccaacttcttcaatcatgtccttgacgctctcccttctacctacctcctcgctcttttttttaaagatagagtctccgtctgtcacccaggctggagtacagtggtgcaatttcagcttactgcagtctccacctcccaggtgcaagggattctcccccctcaacctcctgagtagctggggctataggcatctgccaccatgcccggctaatttttgtatttttagtagagacggggtgtcaccatgttggccaggctggtctcggactcctgacctcaagtgatcacctgccttggcctcccaaagtgctgagattacaggcgtgagccaccatgcccggccatcttattttctccttgttcttttataccacttctctgtttctggactcttcaacatcctcctttctacttaatctttccttttagcctgaaaacctattcgcttcctgctcatcctaaaaaggattctttttttttttttttttttttttaaagacagagtctcactctatcacccaagctggagtgcaacgtcgccatctcggctcactgcaagctccgcctcatggatttgcgccattctcctgccccagcctcccgagtagctgggactataggcacccgccaccttgcccggccaattttttgtatttttagtagagaccatccgtgttagccaggatggtctcgatctcctgacctcctgatctgcttgcctcagcctcccaaagtgctgggattataggcgtgagccactgtgcccggcccaaaaggattctttttaatcctgaattcttctagccattatcctgcctaaggctaccgttaacctctaactgccaggtcctgtggaatctttttctgtctttattgctgcacttaaatgttcgtttcaccctccttcagaatttgctcttctgtattttttatgtttattgatcattccttccctttctcattcctgggctgcttttccttcacaccccccttagatgtgtgtccccagtgtctgtttctttgcctgctgcttttgccacatgacacttacacactgccagctaccacacacaagttccctcctatcatgtgtatatcattgcccttattccatgttgtattaaaattatgtgcttgtctcccctgttacactttgagttccttgtgctcaaagtaagacagtgatactgtattatttattctcatggtttggtatagtgctttggcacatagtacaggctcaatataaatgtgtttgaataaatgaaattcagtgccttaatacacttttgtagaagcattattttatggaaagaatgaaaaagctgtaagtggtcttacatatatagtcatccaacagatacttagagagctctgggatgtgttccttgctgtgcttgttgctatggacagtacagagaaatataagcatctattttgggtcccttttgagaaccttgtgaaactgtatacctagtgaaactgtatatcctcaccctagaaaaatttacaccacacatgtagattttacatgtaatgtaagtcttttaaaaattaatttttttttttttttttttttttaaagaaacagggtcatgctctgtcactcaggctggaatgcagtggtgtgatcatggcttactgtagcctcaacctcctggctcaagcacctctcccacttcagcctcccaagtagctgggactacaggtgcgcaccactatgcccggctaatttttaaaatattttttagacactggttttcactatgtttcccaggctggcctttacctcctggattcaagcagtcctctaccttggccttcagaagtgatgggattataggtgcaagccaccgtgcccacactatatgtaatttcatggtgttcacggtttcttcagggagttcatgtacgccacgtactctattctaagcatttttagagttagagatacaaaagcatgtgaatgaattcaagaaaaatggaatactgaactgcgtgacattgaataacaaatggagtcagcgatgcaaataattctgtagattttacaaaaaaaattaacctggtatggtggcgtgcacctctaatcccagctactcaggaggctgagacaggagaatcatttgaacccagaaggcggaggttgcagtgaactgacatcatgccactgcactccagtctgagcgacagagcgagactccatctcaaaaataaaaaaaaaaaaaataaaagaattgtgtagattttagtagttggaagaagttggagtatgaatgtgtaattatagaacagtgagaaattctacagattgttttattctggtgttgtgctgttgtgttctcatatggttgtctttttggtctgatagctctttgtgttaagtaacagaatacgagtaacaaacagagatctcttcagaagggtgtgacattagaaatgctgtatcagtcatgtaatgaagaggcagatcgcagagcaggatatgacctaggaagccttggggcctgagaagtctaaatgtgtttcaagttcattcatggatgatgctttactagggctagggcaggtaggccacagccctgcagctaagtaggcatatccttgtagctaggagtgcatgcagtaggctttagatgtggcaggcaggcaggcagcactaaagctgggcaagtgatcaggatggatagtctctcctttgaggtgccctgtggtacatagacagatgaaataatggatacacaggtagtcttgtagctaggttggtccagatcagtgggcaggaaaggaggttgagttggggccatggactttgggagttgtcattctagtgagctagctagaactctcagtggtacaatattcttctcttaaaactgacccattagaaagtttacagcctcgactttgctgtggtttattaagacacagatatgtgttcattcgggggccaagcagtaaatggagagtggcatttattgaggccagtatggaggcagtacagagattactgagataaaagaaagaaataggtggaatggaactatgtgatggaaagctaaacagaatagttggtggtacacagtagatagtattacttgtttatgaagatatggtcatcttccatttattcaagttatgttttatattttttagagtatatagaaattctctgccctatcacgtttgccaaagtcaaaacaataacttcatttattaagtataaaaaagaaaaacctctaacataaaatagaattttatttagacaataaaaaaatattgtttggtcctaataagagtaaggttgattcaagatacatgggagcagaatccaaagtgtagaaataggccaggtgcagtggctcatgcctgtaacacttttggaggctgaggccataggatgagttcaggagttcaagacccgcctcggcaacttggcgaaaccccgtctctacaaaaagtacaaaaattagccgggtgtggtggtgtatatttgtagactcagctacttgggaggctgaggtaagaggatcacttgcagccaggaagtcaaggctgcagtgagctgtggttgtaccacggcactccagcctgggtgacaagcaagaccttgtctcaaaaacaaagcaccctggtgtggcggatcacctgagttaaggagttggagaccagcctggccgacatggctctactaaaaatacaaaaattagctgggtggggtggcggtcacctgtaatcctagccacttgggaggctgaggcaggagaatcgcttgaatccaggagacggaggttgcaatgagccgagatggccgtgttgcactccaccctgggtgacagagcgagactgtgtctcaaaaacaaaaacaaataagcataggacatggagataaactgaagatttatgaagacactactgaaggagaaataaaagtaggtttggctaaatggagaaacatgccatactttgaatggaattatttaatactacaacgttatcagttttcctcaaagaaatctttaaatatattcagttttggctgggtgtgttggctcacgtctgtaatcccagcactttggaaggccgaggtgggctgatcacttgaggacaggaggttgagatcagcctggtcaacatggtgaaacctcgtctgtactaaaaatacaaaaatcagctgggcatggtggcaggtaccagccagtcaggaagctgaggcaggagaattacttgaaccctgtaggtgaagattgcagtgagctgagattgcgccattgcactccagccaggtgacagagcgagactccatctcaaaaaaaaaaaaagaaaattatatatttatttatttatttatttannnnnnnnnnnnnnnctcccgggttcacgccattctccggcctcagcctcccaagtagctgggactacaggcgcccgccacctcgcccggctagttttttgtatttcttagtagagacggggtttcaccgtgttatccaggatggtctcgatctcttgacctcgtgatccacccgtctcggcctcccaaagtgctgggattacaggcttgagccaccgcgcccggccgcaatatatttatatatatatacacacacacacacatacatatctctgtttttgtagaaacggacaaaataattctaaagtttattagattatgtgtagtaacagaagaattttggaaatttctttcgacaagagtcataaaggaggacttgccctaccaaatattaaaatatgtcagaattaaaacataactgtcagctgggcgcagtgctcatgcctgtaattccaacactttgggaggctgaggtgcgtagatcacggccagcgtgaccaacatggagaaaccccgtctctactaaaaatacaaaattagttaggcatggtggcacatgcctgtagtcccagctactcgggaggctgaggcaggagaattgcttgaacccgggaggcggaggttgcagtgagccaaaattgcgccattgcactccagcctgggcaacaagagcaaaactcttgtttttaaaaaaaaaaaaaaaaaaagaattaaaacataactgtcatagtggctacatatggagaatccaaaactgagtttatgtggtattttgttaatatacaataaacatagcactttaattctggaggaaaggtggattattcagtaaatgattctgggacaattagattcctacttcacactgataactaaaataaaatcaaatagattaatgagagaactgtaattaaacaaaacaacactcaaactacactggagcagatctgtgaatctgtataattttgagtggagaaggactttataagcatgactaccagagcaaaaaaaaaaaaaacataaaagattgatatatttgattattaaaaaagtaaagatttaggctgggtgtggtggctcacgcttgtaatcccagcactttgggaggccaaggcgggtggatcacttgaggtcaggagtttgagaccaacctggtcaatgtggtgaaaccccgtatctactaaaaatagaaaaaaattagtcaggcgtggtgacacatgcctgtaatcccagctactcaggaggctaaggcaggagaattgcttgaatctgggaaggggaggttgcagtgagccaagattgtgccacttcactccagcttgagtgacagagcaagactccatctcaaaaaaacaaaaacaaatacttagatgtgtccaaaagtaaccgtacatttaaaaagacctgccacaaactgggaaaagtagaaaaaaagtttttaaaatagccagtgaacataagaaaaggtggccctcctcacttgtaatgatttgagaagtgtagtttatttttattttatttttaagaaattcagattgtctatcagctggtgctgaatggtaaatgtgagaaagattaatactactaagtggtactgagggagttgcaaaaacacttaacactctgctagtgggatagtttaagtaaaacaagtagcattcttaaactcttttttaggtaagtaactcatatgttttcaggacattttcagtaagactttactggcagggttgtgtaatgctaatatacttactgactggttttagtattatttttttctcttgccttggatggtctcagtggagtcttatgcatagcagatatattaaaactagtaataaagcaagagaaggaatgtgaataaattatctcagtttaatttctactttgttctatttctatttcatactcctgggaaagaatattaagtgggcatatgtacttgaatagttgttctgttttttattagaaaagaatccgaatctataaaatgttttacatatttgccagggaaacaagatacttgtatagctgtaagaattggaattcatttcattttactgacttttccttaacctaattctgaacacttttgccataggtttgagaataagttgttataaaaagactactattcttcgctaatagtatggacatttcagttcctaaattctgtttttttgattcttgagcatttctaaatttactttttttgtcttagctcttctacagaatcactttcttttttttttttttctttaatttttgagctgaaaatagtactttttataaagaagtgctcaaacaatgattggactaatttctccttgtttctctctttctctttgtctcttttactctctatttttagaattcttctttttaaaatagagacaaggtcccactgtgttgctcaggctgtcttgaactcctgagcccaagtgatcctcttgcctcagcctcccaaagtgctgggattattggcttaagctatcacaccaggcctaggctaatttcatattttgagatggcagaaatttctttcaggtagcttttcctcctcctccccacttaaaatagatcctgatccagaagcctaatggagaaaatgaaaacagcagtatctttatattggaatcttttctaaaacttattttgatctttttaggagatagtgtgggaatcagcaatctagtattacatacatggaatctatcaccttatttttttaaatacagcaaacctcatgaagtgaatttccgtattttgtcttgttcttgttttgcaccactcacgctttgctgtagaatttgatgtatttttgattctgtagagcgtgggctattgatcttcactcagctttcagaggaacctcattagtaagtttgaattttttatttttattttttagttgattttgaagtaaaatgcagcaccattttaagtgataccatttctaaacaatttttagttcaaattttaagttagctaatttagagcttaagaaaattgctataaaaacataaaattaccagctgggtatagtggctcattcctgtaatctcagcactttgggaggcaaaggcagatgaattgcttgagcccagtagttcaagaccatcctgggcaatatggtgaaaccccgtttgtacaaaaaaatacaaaaagtagccagacatggtgttgtgcacctgtagtcccagctactcaggtggctgaggtgagaggatcacctgagcccagggagattgaggctgtggtgagccaagtgagaccctgtctcaacaacaagaagaaaagttactaattgtagtgccttttttcttatgtagtaggcttagtcaaactaagatgatgtattttatcttataaatgttttcccttgaattttaactgaagaatccaatgtgtacctctcacaaacaatttattagtaaggaaaataaatactggtttttattacttaaacaggatatatttttctcttacggattttttttttccttttatctcactttatcatagtgctagaatatttaatcattcatttgagatagggagaaaattaggtttgttttttttttccgttctattttgagacagggtctcattttgttgtccaggctggagtgcagtggcgccatcatagctcaccataacctcaaactcatgggttcaggcgattctctcacctcagcctcctgattaagctgggactgcagatatgcatcaccactcctggctaatttttgttattttttgtactgatgaggtctcattatgttgcccaggctggtctcaaaactctgggcctcaaatgatcctcctgccccagcctcccaaaatgctgggattacaggcgtgaaccctgctcccagcccattttttttttaaatatattcacagcattgtgcaaccatcactacaatcaatttacattttcatcaccctgaaaagaaactctgaaccccttagcagttcctctctgtttgtttcaattttccccagctccaggcaactattgatctattgtcttcataggttttcccattctggacattgcatattaatggaatcatatatagcctctttttttttttcttttttcttttttttttttgaaacagagcctcactctgttgcccaggctggagtgcagtggcatgatcgcggctcaccgcaacctctacctcccaggttgaagcgattctcccgcctcaacctcttgagtagctgggattataggctcctgccactacacctggctaattttgtatttttagtaaagacggggttgcactgtgttggccaggctggtcttgatttcctgacctcaagtgatctgcccccctcggcctcccaaagtgctgagattgcagccatgagctaccgcacctggccatatatattatgataggcttgtttcacttggtatgtttcttccgtgttgtggcatgtattagtacttctttttcatggccaaatattccattgtacaggtacacaggcgcattacattttgtttattcatcagttggtggatattttcattatttccacctttttgacttatgagtaatgctgctattaacattgacttttaaagtttttgtgtgggccgggtgtggtggctcatgcctgtaatccaagctctttgggaggctgaggccggcagatgacttgagaccatgagtttgagactagcctgcccaacatggcgaaaccccatctctactaaaaatataaaaattaactgggtgtggtggcgtgcacctgtaatctcagctactaggtaggctgaggcagagaatcacttgaagctaggaggctgaggctacagtgagccaagatcatgccactgcactccggcctgggtgacagagtgagacttcatctcaaaaaaaaaaaaaaattgtgtgtagacataggttttcaattttcatggggatgtgtgtgtatgcatactcatacatacatacatacatacacacacatacctgcaagataattgctggctcatatgctaaatctgtgttgaagcttttatgtaactgttgggctgtttctttcctttttattatttttttgaaaatggaggtgaggtctcactgtgttgcacaggctggtctcctgggcatggtagctgtatcattttacaatcccacatagctgtttccaacatagctgtatcattttacaatcctactagcagtgtatgaggtttcttacgtttttcacatccccaccagcatttgttattgtctgtctctttgattatagccatcctcgtgggagagtaagaagtagtatctcattgtagattttttttctgtttacaactttactttaaaaaattatatatgcacacgtggtaaaaatttcaaaaagtgtataccaaaagatttaacagtgaaaatagaaaataagggtggtccctgttttcttccaccaaggcaaatattgttataatcttctaaacaacttgtctgccagatttctcattttcagtcagtcctgggcattgacgtaaagaaattcttagacattgcttttattagatcatctcatcccttgctcaaaatcttcagtggccactattgcttacagaataaagttgggatgctatacaggactcttcccagtggaacttctctttttcaaccttacctctcattatttcccaatgttaatccacttactgacctactgtggcatgttctgtgtgttagacatcaccaactttgtgccttcttttttttttttttggagatagagtctcgctctgttgcccaggctggagtgcagtggcgcaatcttggctcaccacaacctccgcctcccgggttcaagtcaagtgattttcctgcctgagcctcccaaaaagctgggacaacaggcgcgtgctaccatgccctgctaatttttgtatttttagtagagatggatttcactgtttcccaggctggtctcgaactcctgaccttgtgatccacgtgccttgggctcccaagttgctgggattacaggcgtgagccaccgtggccagcctgtgccttcttcttttactcctggatttaatcctaacttcaagaacctaccttattaactggagttttagatactttttcaaaaccaagcccacatctgtcctttttagagtcttctctcacattccctgctcattgtggtttgtttttattgcctataacaatggttgttaaactttacattttaaattaatttatgtttgtatgtatttatttgttgggaaagggtctctctctgtcacccctactagaatgcagtattgccatcatgggttactgcttcgtgagctcaagctattctcccatttcagcctcccaagtacatgtaccaccctacctggctaatttttttgtttgtttttttagtttagcttttgtagagacagatatctcactgtgttgcacaggctgatcttgaactcctgggctccagtgatcctcccatctcagccttcccaagtgctggcattacacgtgtgagtcactatgcccagactttaacattttctttttagcatagaataggtcagttttttccctctgatgagatcccatgctgactcttagttaaaacaagcgtggttggaagaagagctagtggtgtcctagctccctacgtactcagttttcccttgtcttctggggtgtcctgaagacatcataggatgtcatgaagtacagttggagaaccagtgctttccgtcatgtatcaaacactcatctttacgaagcagtgtgtagtatctttttgccagtatattttatctctcccaatgcattaaacttttctggagtttagaaaacaaatttatagaattaaggaaatgtccccccaaccatggtgtctagtatatatacagtgacttacagttactaggtgttcaacatacatgtattcctttgattgatttttgaaaactttacatatatatattttttatatacagggtctcactctgtcactgaggttggagtgtggtaatacagatcttggctcactgcaacctcctcctcccaggctcaagtgattctcccaccccagcctcccgagtggctgggaccacaggtgcgcatcaccacacctggctaattttttatatttttggtagagacaggattttgctgtgttgtccaggctggtttcgaactgctgagctcaggcagtccacccgccatggcctcccagtgctgagattacaagtgtgagccaccactgaaatatttatatttttaaacttaatttacttatatttactatatttttatgtttttaattttttaaaatatatttttatactcactagacccaattttatactcctaaaccagggaagaacttttttttttctcttacataggcatggtaccatagacaatgattaaaattgtaattatcattcatttcttagttttgtggctgggaccctgatgtcttcaaatgttagtttgcagatacagtcagccctctctatccatgtgttacatactgtgaattcaaccaaccatggatccaaaataatatgggaaatatgctggggctgtgggtcacacctgtaattccagcacttggggaggctgaggtggatggatcacctgaggtcaggagttcaagaccagcctggccaacatggcaaaaccgtagctctactataagtacaaaaaattagctgggcatggtagtgcacatctgtaatcccagctactcgagaggttgagacaagaaatttgcttgattctgtgaagtagaggtttccatgagctgaaattgtgcctctgcactccagcctgggcaacagagtgtgagactctgtctcaaaaaaaaaaaaggaaagaaaattatatgggaaatgaagagcatctatactgaacatgtacagactttttttcttgtcattattccctaaacaatgcagtacaactgctatttccatagcatttactttgtattaggtattataggtaacttagagatttaaagtatgcgagagtatgcaaatattatatactattttgtatcagggacttaagcatccatggattttggtatccccagggggtattagaaccaatcgcccatagatactgaaagacgactgtagtgtgtgttgcaataatttattttcaaatggatcatttggagaacactattctttaggaaacatagcctcctaagttctgttccatccgtccctttcacctccatggcgttgtagcatcctgctttcatgactgtgtcatcactcggaagggactgcttctcttccagaatgccttccaagatctactctgaccacagctgtaaactacacttctattctcttcttgcccctcacagcgctctctgttcctctgagatcttaagctctgtctactcctaatccagcctgctgggtgtggctggagaaagtcccactggagggctgattagtttccagctcttgcctcaggagagctcagcagactttttttttttctcccttaaacctgtttctgcaaccttgatgaccactccttctagtccctcacctatttgctttattcatggcagaggctctttcttcctgcttgtcagtacaaagaggcaggatttttaacctggatctgtggattctcaaggaatttgtggagagaattcagggcattgatgaccttggatgaagaggaatttacatctttatttacactaaccttcgagtgaaatttagcattttttcccatttaaaaatataggcaacaaacaactagtgttagcagtatttatgacttaagcacgtatagaactcagttaattccatattgcttgatgttatggatatctcaaattattattttatatatatatatatatttgagatggagtctcgctctgtctctcaggctggaggtgcagtggtgcagtctcagtccattgcaacctctgcctcctgggttcaaacgattctcttgcctctgcctcctgagtagctgggattacaggcgcgcaccaccatgcctagctaatgtttgtattttcagtagagatggggtttcaccatgttggccaggctggtcaccaactcctgacctcaagtgatccacctaccttagcttccaaagtgctgggattacaggtgtgagccaccgcacccggcctcaagttatttttagaaacagaatcttgctatgttatccactctggccttgaactcgtgggctcaagcagtcctcccacttcagcctcccgagcagctgggattataggcatgtgccactgcacccggcttcaaataattatgtatgttcatcacctctttaaatttatagtagttattaaacctgttactggatcttaatatttaatgctttaattaagaagcatgtatgttactatgccaacagatttttttagtttttgataactgcatttcattgttaattgttctcatttgatttcctgtgtattttatgaatttaagtacattctgaatacggttacataggcttccctaaaatgtcaaagggcccatgtattaagaaaaaggctgagaatttctaatctggaggctccccacagtcctgttttgtcgtcatacctgtaccccattctagcctgaggagcatggctccacctgtgcccttggttttgttgttccagttcatacatcctgcacccttactgtgtttcttatccgcaacttgtttatgttattcttcagtattatagtctttaatataatctgtataatacgtgatgtagtatatgctcgtagtatacaatgcagttagaacagatgagtatacaatgaaaaaataatctcccctctaatccccagtcccacttccctgggaagcctgtggtcttgtgtacaattcagaaaatgtttatacacatattatttatttatttatttatttattttttgagatagagtctcactctgtcgccaggctggagtgcagtggcacgatcttggctcactgcaacctccgccttcctagtagttcaagcaattcaaggttcaagcagttctcctgcctcagcctctcgagtagctgggactacaggcatgtaccaccatgcctgcctaatttttgtatttttagtaaagacagaatttcaccatgttgaccaggatggtctcgatctctttacctcatgatccgcctgcctcattctcccaaagtgctggcattacaggtgtgagccaccacgcccggcctatttatttaatttttaaatggagcttccctcttgttgttcagactggagtgcaatggcgcagtctcagctcactgcaacctccgcctcccggattcaagtgattctcctgccctcagcctcccgagtagctgggataacaggcatgcgccactatgcccagctatttttagtagagatgggggtttctccatgttggtcaggctggtctcgaactcccgacctcaggtgatccgcccgcctcggcctcccaaagtgctgggattacaagtgtaagccactgcgcccccgcctatacacatatttttaatgccactccagtctgtgttggaatcattttacttccccttattttcttcttgtattcttgaaggcctcgatcagctgctgctgctaggctgtcactgtcactttagaaagccagagccttttgttcctcagaactttgttcttaattgtatcgtagcattcactgtattcgattctaaaagatttgctttgtttctgtaactaatctgtcacacccaggagctcctacaggaaatgctgggaattgtatcagtcaaatgtgaatccccgccttgtccagacttatgagtgcattgtaggtactcagtaagtgctaaaaatgagtaagtagtcccagttgccaggttgtcacccactgataccaatctatatactgatactttatatagtatatagattggtccacatataactgatgacacataatgagaaactgtcttaaaaagttgttaaaaatgccacaagaatagtaattgatcaaaacaatatgattttttaggtttatctagaattttgatgtttgagaaaaggctgatttaattgaattgaaatgggtagctgaggattttgatgacttctctggaagcacatttgagggtttctgatgttaaatctgatgttaatgattatttcatccagttttatgtcattttatagtttttatacatttaagtttatatttatttctgatgtttaaacactagcattttagttatttgaccattattctggccctttaagagatgctcagacaagtttgaatggtttttcagaggcattattggctcagaggtaaaagagggaagattgagaagctgaatacgtactcttgtttcctgggtatggggctggggatactcagaagagtttcacacattggttcagacatttctttacgaccaccaccaggtggcaccactggcccaaaatgactgggtttctgcccagaatcagaagggaaggtgttgagagcccgctgctatgggggtagcatggaggtaggatacagggggtggaggtgatacaatttcgttctttcctccaacgtcgcctgctagtctagaggcttttataaattgaaaaactaattcttttatcatctcatctgatggtttttatgtttttccttttttctctctatgcctgtagtttcttcagaaacaggtaacacgtttctaatagtcactttgtattcttgcatcttgttcttacagtgcttttgtttctcaccataggggatgatggaaaattaatatactttgacttagggcattggtaaaatctgcatgcaaattcccacagttacctgtagattagagccagttgttttttctgaactttgcaggaatcctggttacaacattgtactatttactaccaacaatgttttttttaaaatccagacttgctgggcatggcagctcatgcctgtaatctcagtgacttgggaggctgagatgggaggattgcttgagcccaggagtttagggctgcagtgattgaggcactgcactccagcatgagtgacagagcaagatcccatctcttaaaaaaaaatttaagaaatagaaacaaaaatccagacttgtaaccattgtaaaataaatcagaatttacgatagtggatattggtaatagtgcagaatggatacccagatctttttttttttttttttttttttttttttttgagacggagtctcgctctgtcacccaggctggagtgcagtggccagatctcagctcactgcaagctccgcctcccgggttcccgccattctcctgcctcagcctcccgagtagctgggaccacaggcgccgccacctcgcccggctaattttttgtgtttttagtagagacggggtttcgccgtgttagccaggatggtctcaatctcctgaccttgtgatccgcccgtctcggcctcccaaagtgctgggattacaggcttgagccaccgcgcccggcctggatacccagatcttgcttcctttctagctgatgatgcaatgttgacctgaaatgcattacttatatagccagggttttcctcagcatcctgatgctacagcctcattttgtactaactctccacttctgcacatcttcccctaagtctttactcatctttaaaaagagctacttttggtgaaattttaaaatcaaggaatattcttgatagaatcacacttatgtgtttccccttccccatttctgcctcgaaaccagaccagactgctccataacctgtgaatactttttttttaagtttggtattgttaacagaaaatttaagattaaaatgtagcattgagaaaaatagatttattaataatgtcctcttaacacagcttaaattctggtcagtggaataaagcctgggccactgaagttttagatgcttacttgcttttccacactggttcttacttggggatccttttagaaattcgtttataataatatcataaaaacatatttaagctactttgtgtgtaaatttggggtcttttgatttgaagacagcttgactcaagattttctaaatattttcacacacatacataccctgtagtgagaaaaatttatctatttatatggttctataaaaatctctaactgctttgagctttaatttcttgaatcaaaagtgtattgtctttgatgctgagcttctatctaaataaatgctttatttacttaaatgtgtgcttttcaaaaactagtaagattaaaacattaacaggatcttacatgtaaaggaacagtcctgttgcttcttccagaagataatatgactggtttggaattttcctgtagtatagttttttgtctagtgttgtaagaattaaaggaatttcaggatcttaaagtaggttattatttgatgttttcttggaacattttacattcttgaaaatacacgtggctaaattaatttttgccaacaatccacataactttaagatagtgtagagtaggacttgattcaggttagtatcaaataagatcatatttttagtgccatcagtagctttcagcaaagatgaggtgttggtaagatagcattagtctcttggaatctcttacggatattttccaaaattcagccatttctagtgaatgctccattccacccccatctgagtcctgctactctggggaactccctcagcacactcttggctcttagaattgctagcagtgggagtagtgctgctggtggagctggcagctaagcccagaggtggattgatgcttttatttcctgatgtacaggtacacacactcatacctacccacacctagtttgggataagaagaggttagaattagttaggcttgaagttccgtgcttacatttgctggctcaaatttcttattttggcatcactttgcccattagggagacaatgacagttatagaagcattgccaaataaaaaattcctctggagtaacctcttgttaggagtattgtgtgtttagttgttgattcgtcccttcctcctcttagtggcaacttgcagtactgggaggaaacagtggctgggagcttaatttcctcagcagagccagatcagcagaagtattactccttagttcgtagtaggtggtaccctatgggtccagtcatttaaatgcaaacctatatctacagagcatttcctaatgccgtcattgcccagtggtcctttatttagctgagtctaactcccaactagagaaaatttcctttgccagacagcagtatggtcagctaaacatgtggatggtacatttgctttcgtaagtcagtactcttcagtaacattagtagaagagaagaggacacaaagtgagagtgtgttaataggaagtccagatacgcctgccacctgaactttctgagacaggtaatactgtagggcctgaacttttagcagagtggttatatatgaagaagtgggttctgggaggggttaaaaccacttagaatggctttactttaataatggcaagagtttgcttggatattgaccattgcacatagacatgaatatggaaagttaaaaacaaaatccacatatatttggccgcaagtattttgaagatatatctaattagtacatccattaaacaaaagagatattttaggccaggcgtggtggctcacgcctgtaatcccagcactttgggaggccgaggtgggtggatcacctgaggtcaggagttcgagaccagcctggccaacatggtgaaaccctgtctctgctaaaaatacaaaaattagcttggcttgttggtgagcgcctgtaatcttagctactcgggaggctggggcaggagaattgcttgaacctggaaggtggaggttacagggagctgagatggtgccactggactccaatctgggtgaaagaacaagattccatctcaaaaaagaaaaaaaaaaaagagttatttctgatgtattgatagannnnnntttttttttgagacggagtctcgctctgtcgcccaggctggagtgcagtggcgcaatctcggctcactgcaagctccgcctcccgggttcacgccattctcctgcctcagcctcccgagtagctgggactacaggcacccacaaccgcgcccggctaattttttgtatttttagtagagacggggtttcaccgtggtctcgatctcctgaccttgtgatccgcccgcctcggcctcccaaagtgctgggattacaggcgtgagccaccgcgcccggcctgtaattgttttttaacatatgtctttgttggtgattcatatgtgtgagtgtagctgattgcctgactatatgaactttcaaccaaaaccattctttccagatgcttttactgactctgctatcagtgctaaagtgaacggcgaacacaaagagaaggacctggagccctgggatgcaggcgaactcacagccaatgaggaacttgaggctttggaaaatgacgtagtaagtaagatctttgtaattagtgctagactctgtggtcagtgtggtatgcatatgacatcctatcacttggttgtaattgaagtgtgtttttgttgttgttgttattgtagtgagtgtatttagagcagcaagtttgctgtataactagagactttctcccaagcagtatataaagaaaaatgtttgttattttacttgtagggattaagcaggagtactgtctgttcttgtggatgctcatgaattacttctttgtgattaaactaaataataataagcaacttaagttaaaattagaaatcataggaaatgccagtgtgttttgctttaacaccctgccaaataaggtagcctaaggaaagtggtgtcttaattgttgacttcacctagagatgaggttgaagtaggacattttaagcttcttgtctgaagaaaaggttgtcattattaagataattaggttacattggaattaaagcattacataaatttattggtcttaaattgggattgttctcaacagaactcttatttctaaaatgcttcttgtcacatactagttttgcttctctctttaatgcattatctgtacttgaagtgcttagctgggtatgctggcacatgcttgtagtcccagctacttagggggctgaggcaggaggatcacttgagcccaggatttggagtccagcctgaacgacataatgagaccccttctctttttttttttttgagacggagtcttgctctgtcgcccgggctggagtgcagtgaccggatctcagctcactgcaagctccgcctcccaggtttacgccattctcctgcctcagcctccggagtagctgggactacaggtgcccgccacctcgcccagctagttttttgtgtttttagtagagacggggtttcaccgtgttatccaggatggtctcgatctcctgacctcgtgatccacccatctcagcctcccaaagtgctgggattacaggcttgagccaccgcgcccggccatgagaccccttctctacgaaataaaaataaaaacaaatgcttaataaagactctatctttaggatagagagcatagagatgcaaagcagtcttttgccaaaaatgagagttatggtagcaaaatttgagtagaatgaagaaccttccattgagtagaaagagaatttgtaacatatctgtgtttgatgtttaaggcatcaaacttaatcagcttaataatgacactcttcctcagacaagaagcctaaaatgtcctactttgacctcaagtctagtaataaaactggacatacacaggcaacatgtcattaattttcaaactttaacgactcatatataaccaaatataatggttctcaagtgtgtatatcacatcacctgtatgaaaaatgtgaggaaacagagacttcttttacactattggtgaggtggataaattgatagaggctttctggagagaatctggcaatgctcatcaaaatttaaaatgcacatacactttgttccagcagttctacctctagtaatttatttttgccctcatatatccataagacatgcaaataattatatgtgagaatattttttttttttcctgcagagacgaggttttaccatgttgcccagggtgatctggaactcctgggctcaggtaatccacccacctcagcctcccaaagtgctgggattacaggtgtgagccatcatgcccaaccaggatttaattaaattaattaattaattttttgcagcattatttcttttgttgttgttgttgttttgagagatggagtcttactctgtcacccaggctggagtgcagtggtgtgatctcagctccctgtaacctccgcctcctgggttcaagtgattttcctgcattagcttcctaagtagctgggactacaggtgtgtgccaccacacccagctaatttttgtattttcagtagagacgaggtttcactatatgttggccagacttgtcttgaactcctgacctcaggtgatctgcctgccttggcctcccaaagtgctgagattataggtgtcagccaccatgcctggccatagcattatttctaatagtgaaaactggaaacattctaagtgtctatcagtataccatgagttagatttatgatgttaccattcagttgaaacactacacatctcccaaaaagaatggcgttccaatagggaaagatatctaagatttactgaaagaaaaagcacattgcagaacacttggatcctatttgatttttttttttgagacagagtctcgctctgtcacactgcaacctccgcctcctggattgaagcgattctcctgcctcagcctcctgagtaactgtcgcgatgcctggctaatttttgtgtttttagtggagatggggtttcaccatgttggttcaggctgatcttgaactcctgacctcatgatctgcccgtctcggcttcccagagtgctgcgattactggcatgagccacctctcctggccatgaatgtattttttaaaaagagctgttcatattcttattgcatagaagatgtctgaaattacacccaataaactcttttttttttttttttttttttttgagacggagtctcgctctgtcgcccgggctggagtgcagtggccggatctcagctcactgcaagctccgcctcccgggtttacgccattctcctgcctcagcctcccgagtagctgggactacaggcgcccaccatctcgcccggctagttttttgtattttttttagtagagacggggtttcaccgggttagccaggatggtcttgatctcctgacctcgtgatccgcctgtctcggcctcccaaagtgctggaattacaggcttgagccaccgcgcccggccgataaactctttttgagacagattctcactctgttgcccaggctggagtgcaatggcatgatctcagctcactgccacctccgcctcccttgttcaagcaattctcctgcctcagcctcctgagtagctgggactacaagttcccgccaccacgtctggctaatttttgtatttttagtagagatggggtttcactatgttggccaggctggtcccgaactcctaatctcaggtgatctgcccacctcggcctcccaaagtgctgggattacagtcgtgagtcactgcgccccgctgaaattcttttttttttttttttttgtctttcgagacagagtctcgctctgtcgcccaggcttgagtgcagtggcgccatctcagctcactgcaagctctgcctcctggattcacgccattctcctgcctcagcaggagtagctgggactataggtgcctgccaccacgcctggctaattttttgtatttttgtatttttagtaggcctgccttggcctccggaagttctggaattacaggcgcgagccactgtgcccagccggaactgttagtagtagtgggattggaagacatttactttttactggatgtctttctgtattgtgtgctttttttttatgtagggcatacattacttaagtaattttaaagcctccataagtaattgtaatttcctgcccatgtgtttggcaaaaggaattgtgttggtggtagacttacattatagtcttatttggagtagcacaggaggaccgaaggttaataggtgaactttgaggcaagccttagcattgaggttgccatcagcattgcttggttgttgtgttcgttcttctgggatggattacaacctttactggactttatagttttcaccagtaaggctttaaaaaaggagttgaaacattagagaagtgattttccagacattaatattcactggtaaataatcttccagcctgtggctcaactggttgattcttttacttttaagaatgcggcctcagctgctgtgcctacggagtagaattcttttatttctttactttcttaataaacttgcttgcccccggctccccgccaccaaaaaaagaaggcagcctcccttttgcaaatggtaatttcctatagtttcctcgtagaattgtggagttacctatgctgaggttataggttagggtattgagatccagagttgccacttctgaggtctcacaactgctaatggtaaaaccagttctaaagcccagttcttgtgactttgtccagtgattgcctgttcaccgtttcatgctgccttcccatttgagaattcccaggaggaaggggaggttgccagggacctagtaccgtggtcccaccttggaatcgttgaacatgggggaaagcattggcttctcccttttttctcccaaatattggaaatatttttggctattaaatagcaccccttgttccatgtggaatcctttgtttaaaagaagtaaaatatgtacctcctgtcctccacagacctgaggaccagtgatctcaagaaggttacaggtaaacgcagatgtctctactgaaagatggcttttacaggttagagaaaagagagaaccctgatctgaaggctattttatgaagtgattaaaatgttctaaactttaaaaataactgctcaaataattgtgttgtatagttatttatcaactgtaagggctggtaagtatttttctaaaacattttcaaggaaattttttcctgttttctaatttgctaattttgctcaagtagcttgttagatattgttaatatagatgttggttataactgaatgaaagggaacaaatactttgtcattttgaaaaacaagcttcattttcttctagtctaatggatgggatcccaatgatatgtttcgatataatgaagaaaattatggtgtagtgtctacatatgatagcagtttatcttcatatacgtaagtttaaaaagtttgtttttattttagtgcatttgtctttgattttcatcaacttaatttatgatgaataaatgtttccattagtttttaagttaaacaattacgtgaaataatttttctcttattaccacgtgtgataaatttccattaaaaaaagggaataaatgtagtttgcttataccctatttttatcctctaaacaaattttggtttttttttttttccttttcttttgagacggaatctcgctctgttgccaggctggagtgcagtggcacaatctcagctcactgcaacctctgcatcccgggttcaagcgattctcctgcctcagcctcccgagtagatgggactacaggcgtgcgccaccatgcccagccaatttctgtatttttagtagagacggggtttcaccatgttagccaggatgatctcgatctcttgacctcgtgatccacccaccttggcctcccaaagtgctgggattgcaggtgtgagccactgtgcctggctggttttgtcttttaagttgttaaaaaacacaaaatttgcaagggcagagattatgatgaacagttgaactagtttttaaaatatgttcctctggagaaaaagttacagaaaaaaggttagaattttgttttataaataaacagatcactataacttttagttttagtgtttttttgttcgtttgtttgttttttaaccagtattctaaactctaaactttcttagtagttgattatgacagatatataaactgtggctttaaagtactcattttgcttttcttttcctcatgtttcagggtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactaggtatttaaaggaaatcatgatgcagtattttggatacacaactcaaggtctgtgtgagacggtgtattgttactatatttcctcttcctttaatatagcttaggtagagaatgcaagtagaattggtttaagatctgttagagagaaggttatggtaatcttggaaaatatgcttttgagagtaagctctgtggtatatcacggtgagcaatccaaggtcttgaagagcttgttaaaatagtggtctggtaggggatacgtgtaacaatcacagcagtacaatatgatttgcttggttaaaggcatgttcaaagtacactaggaacatacagaatgaggaggagctagcataacctatagagtcagagaaaacctcactgaggaggtgacattttgtgataagataatagggtctttgacattcaaagaggagttgggagaagaatttctcacctgatgaaaagccatgtacaagcatggctgtgtgagaaaatttggccagctcaggtaagggctggttgttgcatgtgtctggaacacaggatctgtgtcgggtgcagcagtggcagttgacagtaggaactgaggtcattgaaggacttggcatgtcatgctaaagagcaccctgttggaaggagatgaggtgaataaaccctggggcattgaggactggctgatatacagagaacagttagtgcattgaaatagttcaactgtgagaatttgttaaccacctagttcagggatgaacctgaggtttatttgataactaagtgacttaatggatgtactggtgagagagagaggaaccatggagcaagtttgaggggaaaaactatgactccatttgtgcagctaattgcatttgtgggacttgtgggtctttcatttattcataaacatgtgttcagaaatacctgctacctatctgataaactaagagatgcatcctctcttcaaggcagtcagcttagagtctggtgatttgaattgacatgtccactgacagatgttgacattgtgagactggtggttcagtttgaggtttcatcagcattgccgatattggagccatggaaaaccaaagaacagccagtgaaagaagatatctcagagaaaataaaattgagaaagtgaaggacaagaaatgttgaagatagaccaagattgatagaatcagccacagagaggtcaagtcggataagaatgagcacacatctgttaaactttgtgcttaggagcagaatctaagtgaagggacaggccagaggttagaactcagggtaagatggaagaacagagcatctgggagtgaggcagtttggtttagtgtagaacctttttgtaacaagcattcccttctgtgaagatgacttttagatatgtttcattgacttggtaccttttggaataaaatgatttagaggatctctcattttcagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattcttgttcagaccaaagagtagttaatggaggcaagtattttgaccagacttgtcaatatcattgatcaaatagttttctaaatacttaaaatagtttgcataactgataagaatgtgcactttaatgatttggggagtagtttttcacttcagcattacttaaaattggcttttgtggatatcaaattagtaaaacattgtgtacgtcattggcatatacattatttagcatgatgaaatattcatgataaagtgctacatttaacccaagacaatcacttggccaaaaacactccacatataaagaaattggaaactttgggtaggttctcaattttaaaaacactggataataaaattatttagacataatttatatggaaaattctaacctatgtgcaacactgtggttaatatagattaattctcattatttgtttctatattatgcttacttcaagaaaggatctgaggtagcttttataatataagacatgattaagagtcatgtgaagaaagtaattaaagaaacgcgcttaaacaacaacaaaaacaacccttagtctaagggtggatgttacagtttagcaacctaagtaaaagaaacctgaatcattagtaggaagacattttttactctacctctaaatctaggttgaatatgtcttgtaggttgtggatcttttccataaatcagggatactgaacaacagttctgtggatagtatgggaatagtaatagcaatagtatattactaactttgggaaaagagtggtcattcaattttagctatttaaatttggaaagttagaaagatgaaaatagagaacgctcagtttccaatttcatttgttttcattgagtcttttctccagaattcctctccaaatggacactcttgagtattttcagtacttaatattgggggtgaaatttctttgctcactgaggaaagattttagttgtttataaacagaattttaaagctaaaaaacctgaagggggctgaaaaatgtatgatactcaagtgtgtggaaccctatggagaggagacctggactgtttgataagattaaggtaagtgatatgtaatgttaaatactatgtgtatctttacctaggcatatccatcaatataaatttatttggtgatgactgctttgtagttgcagtatttattaagcagtcgcttagataactgtgtaaattatttagaaagtctccctttttctagtttaatgaggtcaagacttttttttttgaaagagcaatgaatattatcatttgatactctcgtgactctagaagagtaatgttttatttctacttaaatgggacttgcttaatgagatttcaaactgaattttaggttcaagtgtaaacctgatgaaaatcatagataattgtaaggaaccagcatttctaattggatataatagctactgcttattttcattatgcctcagagttaaaactaatacagtaaataatcttattcctgagtaggaattattgtgatttattatgtgaaattatctagtgtatgttatattcctttaaacaactgattactgagaaacagttatagaagcaagattaataggcaaagtcttaactgtcttctttaatagtgtgtgtagatcctaattaaccctttgggaacgtgtattcatttaaacagacttaatcttaaggaggttaaagtaaaatgtgaatttatgtctgttaagttatgctaaaacttatcacaaatcaaatgactgtcctcaaagggttaaaatgtacaagaaatcatttttgtcattttacttttttttctgtttacttttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaaggtacaataccacaatttgttcatgtttttgtttgtctttgtttaactcctatgtgagtttataattacaaaatagtttcctcttcattatttaataacctacaatttctgtgttttaactttagtttattacaactatttctattaaccttttgttcattagagagaaatttgataaatgttgtgtgaagctataaactctcctgaattgttgtttaaaaagggagtttatctctgcctgataattatgcttctttacagccccagaaaggtctgccccacagccttccccctccttatttgcactgtatacaggagttaaacaaatgaactttcttcaaccagtcttgaactttggttcattttacggctctttggtcaaggtcctagtgaaccttcctattggccataagcaggaagggtgtttctgggtcatttttgagagtgacagcccatatagctgcctttgcatgtctgctcttcaattaaagtagtttgatttttagaatgccagaagaattctaaatttaactgagtaatttttttaaagttagctttgcaatcttacacagtgaaaggctgctttaatctgggagaagtccttgatctgagataaaattattgataaaaatgacatgaatttgaatattttagctatttttttctcatcaaaaataagaataaaatcttgtaattcttattcagtatttggtgcttaatccatcattgccacatatcgaatacatggatatgttgtagaaaggtaacattctaattttaatgctacccatatatatattaaaaacctgttttctgaatcataatgtccttttgatattagttctgaatgtttatgttaaaattttaatctgatttgttcattaaagttagttaatattgattatgttgggactaataaagttttctgcacaaaatgtgtttctcctgcttccctggagaaaactatattggctacttttaaataaattgttaccatctaagcaggcaggtcatgtgaccttgaagcatctaaccttgaagagcaagttccactgattttcaaggtgacttctttgctcaaaagggccttaatagtggtcactgaatgcaaagttctgttgatatttttcttgaggtccattatttgaataagtgatatttatttaatgagaatatactaaataagacatgatcattaattactgtgaacatttttattacattaagatataaggactgctgatagactataactattcacatagaaatatacgttctgtgtcagagatgttgaatatttccatttgaaaattatagtgcataacattagcattcttctaaagatcatgttcttgtttaaattcctgttgggagccaggcatggtagctcacgcctgtaatctcagcactttgggaggctcaggcaggcggatcacttgaggtcaggagtttgagacccgcctggccaacgtggtgaaacctcgtctctactaaaaatacccagctacttgggaggctgaggcaggagaatcacttgaacctgggaggcagaggttgcagtgagttgagatcgcaccattgcactccagtctgggcgacagagagagactctgtcttaaaaaataataataataaaaaaaaacaattcttttgggaacacacattaatttgaagttctaaagagtttggcagcagggtgagagagtgaggagatttggctttgacattaggaaagttttcgcttggtattaacaccagtagacttatctgatgagggccattctgtccactcttcttagctaatagattggtctaatgcacagtaggctgatttagaaagagtagtcactagtggcatggcagaatcaataatgcagaattttgacaattcatgtagtgctgatttcttccccaaatgtcagttatattggtcatctattaatagactaatacaagtcatctccttaatagaattttcatctcacagcctgctaagcctaagaaactgcttacaggttactgttactgcttactgttttaagccgagttttaaaattgatgatcatgatagaagagataacctaaaattttagagaaatttaagaagggtatgtacatatattttagtagtatcgagtgtatagggattaatagtcttctgtttaaatttttttttcctaattttagaagtaatgtagaaaattcggggtgtggaaaggtaaaatatatggaaagttaaaaatattttatcatgtagtcataatttctagtaacctatttctttacaaataagacatagttgaaacagattgctacagttattttaagagttgacatcttattgttgatttcttaccaccaacttcatccctccctttctttaaaaataaagggaaataataaaatttatttacaaaactttatggcattccacaaaataattctgaaagaattagtatggccaaaaaatatgtacggtgttgtgtttttttttttttcctatttttaaccaaggaaaaactgtagagtgagtgagagtgtgtgtgtgtgcatgtgtgtggggatgggtgtatttagcagaaaagtagtactgatgaacatcatggcatttatgtgatgttcactgtttcttccttagggcctccaaggatgtccccaaaggcccagcgacatcctcgaaatcacagagtttctgctgggaggggttccatatccagtggcctagagtttgtatcccacaacccacccagtgaagcagctactcctccagtagcaaggaccagtccctcggggggaacgtggtcatcagtggtcagtgggggtaggtaacacttgggcataatgacggtactcattttgtcattacactagatgtaaagagggctgagctacaactctgtttgaggaagtgtaagtatatatatattaaaaatagtagaatcaccaggaattgggaagcccatatttttattctgggctctaccacttattcaccatatattaaagcaagtcaaacactcattctgaagttgagatttctcagtgagtaaagtgttaataatttttgcctagtctacattatggggttgtgatgagattcctgtaaggttcataaatatggatatattataaaactataaagttttgtgaagtacctctcgaatgcgaggctaacacagtatgtaacactatttgtagggatcatatttcctttttagcagctttgtttatcattacattctgtaaacatttatttttggcttacattgtagtgtgtttctatagcatctgtatagggcactaattcccaactatatttccattataaggaatatgaaatacaaatgaagcgtccaagttttatctgtgattagcataaggaatatgctgacaccagctataaaagtataaaaattaggctgggcgcggtggctcacccctgtaatcccagcactttgggaggctgaggcgggtggatcacaaggtcaggagatcgagaccatcctggctaacatggtgaaaccctgtctcttatactaaaagtacaaaaaaaattagccaggcgtggtggcaggtgcctgtagtcccagccactctggaggctgaggcaggagaatggcgtgaacttgggaagcggagcttgcagtgagccgagatcgcaccactgcactccagcctagacgacagagtaagactccatctcaaaaaaaaaaaaaaaaaaaagtataaaaattagacgttgacatgattttacaataaggctgactgcttttgctactttgccaatcaatccttagtgctttgttcccataactgtggtgagcaagagcttaaaaaaaaacaacacaaaaaaaacttaagtctatttaatcagtccgtagaacctttaaaagaaacaagatcggccaggtgtggtggttcatgcctgtaatcccagcactttgggaggctgaggtgggtggatcacttgaggtcaggagttcgagaccggcctgaccaacatggtgaaaccccatctctactaaaaatataaaattagccaagtgtggtggctactcgggaggctgaggcaggagaattgtttgaacccaggaggtggaggttgcagtgagccagcatcgcaccattgcactccagtctgggtgacaagagggaaactccatctcaaaaaaaaaaagaaaaaagaagcaagatcttcaagcttaaggaaaacgaaaacaaaacaaaacaaaacccaactgttaaatctgtttttagttgatatacatttctgctcagcttcatgtgatgtacattcatgtaattgtaccataaattcgtttgtactctttattttcttctttggtcttcagttatctaaagactaccaagaaaacaaaaatttaaaaaatcttcagccagccaggcgcagtggttcatacctgtaataccagcactttgggaggctgaggtgggcaaatcacaaggttgggagttcaaaaccagcctggccaacatggtgaaacgccgtctctactaaaaatacaaaaattagctgggcattgtggtgcgttcttgtaatcccagctacttgggagactgaggcgggagaattgctcgaaccaggacccaggagggggaggttgcggtgagtggagattgtgccactgcactccagtctgggctacagagcgagactccatttcaaaaaaaaaaaaatctgcttcaactattccattaatcttttgacattacttagatggtctggaaattaattttgagaataacatgattagaagtgagagagtataagcatagttttggagatacactcagaatagcattatagatttgctgtttttactaattggaaaaatggcagttgttgagtaatagttttcttccgtgacgcttgtgacttacaaaaaaaaacaccactaaaatgaagtaatcaaaccattttctctaaacctttgaatctaatctctgcagataggtttataatggtatatgaaacctattagatacatacttggaagtcgtatgagatacaaaccctgtttttattatcttccccttttgactaacttgggtctcaagtttccttgattactgcacagtgaaccttgatgtcgctataaagaatttatagagctaggcgtggtggctcatgcctgtaatcccagcactctgagaggccaaggtaagcagatcacctgaggtcaggagtttgagaccagcctggccagcatgatgaaactccgtctttactaaaaatacaaaaaattagctggatgtggtggcgagtacctgtaatcccagctacgccagaggcttaggcaggggaagcacttgatacatttagttaggagagaaaatcatacgtattagtaattgttgtttttcttcagatacttgtggttttgattgccagcaaattcctaacattttggaaaagaaaacagtaatgggataaagggaaagggctagagaggactgttttacctaggtcttaagagaagcctctttgaggaagtaacatttgaactgagaatgtaataaataaattttccctttcttctagttccaagattatcccctaaaactcatagacccaggtctcctagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgagggtatgtaacaaaaggcttctagatccataatctcagctgtgaaattgaatgttagagagtaacattatatgaaaaaattctagcttatttttattcatagacaaatatttttaatgcacatttaaaagtttgtgtaaattttgatgttgtttaatactactaatttaatacaatgtctgtgttagaaaggttaacattcctgggtgtcaaatacctatgtaaataaaattattggtgtttcatatgacatctacaaaggaaaaaagcctctgtttaaaatgaaagcattctttcccaaaaacatagaaaatcaaaattattgttcagtgttttcttgttttacttttctaacttctaactctgaatttaaaaaaaaaaaaaatgttttctagctaaagattccagacttcaagatcaaaggcagaactctcctgcagggaataaagaaaatattaagcccaatgaaacatcacctagcttctcaaaagctgaaaacaaaggttagagtttaaagaatcattaggcttaactgtagaaataggaaggagtatgtctaatttcatgcccgtacagaatattttcgttcaacattttttcttactattgtgatagataaatgtattgcttgacaaattccaaaatccaaatttaatatttgaaattattttttgatcttatatcttattctaatttctatcatctcataccaaaaagaatgcaatgttaaagtttaaaaataaacctgtgtctaacagttcttaattttacaggtatatcaccaattgtttctgaacatagaaaacagattgatgatttaaagaaatttaagaatgattttagggtaagtgttgtactgactgattaatttgagttttaaaaaataaacattactaaagatttatctatttatagaaatgcattatgtatacaatcagaaacatcaaaccatatatgtagaaagcagaacattcttaaagtggtctttgcctatcctttaagtgggataactaaaatcatgagatttggtaaccaatttgtaggtatcaaatgagagtatagccctgacatttgaaaccaccatagcacagcttagtatttgatggtcatttgattactttgttaatgaagctagatattagtagagcaaggccaagtcattaataatctagtgtggcaaatggaagatgtactggactctggtgttctgaggtagttggagatttgtactttgtacacaaatatattatgtcaaaatctttctgtaacattatttctctatcttaggacaggctttgcttaccatctctccttgattgtcatttcattcttttgcacattatatactataatacactatagatatcaaggtagattttgagaccaaccaagaaatcttctggaaagttaacttcttagagaggtaaatctaaataccagccttttaaagaaagtagctgaattaaaggatgagtgaatcaaaggcaaaggcagcctttcctcagcctgtgttttagctttctaaatgttaataataacttcattcttgatttattggtaacattcaaaatactacttattatttcatactttagcacatgtatgtattcagctttaatgctattaacagttgttaacttaaattttaatttgttggctgggcatggtggctcacgcctgtaatcccagcactttgggaggccgaggtgggccagatcacctaaggtcaggagttcgagaccagcctggccaacatggtgaaaccctgtctcgaccaaaaatagaaaaattagcttggcatggtggcgggcgcctgtaatcccagctactcaggaggctgaggcaggagaatcacttgaacccaggagacagaggttgcgataagccgagatcacgccactccactccatcctgggcgacagcaagacttcgtctcaaaaaaaaaaaaaaaaaaaaaaggtgtttcaatttgttaaacaatagttaacgcatacacatgatacaaagaatattgaatatgatcatgtgcccactacccagcttagtaagttaagcattctaacacaggtaaactcctgttatgtatttgctgctcctcaactgcttccccctcttcccttccaaaaggaagggtttcttttctgtgcagttgtttatatttacactgcatatgaatatatctgtgagcaatagatgatatttttgcataatcttaaatttcctataaatgatgtcttgctgtaggtattcttccccatttgagttttttcctcagcattatttttttaacatcattcagccccctcttatactacacttggattgaatttaatatctcatgaagaaaaaacatttttactttgaagcatgtgaattagcatgtttttgtaacagctttattgagatataatttacatatataaatcaaccatttaaagtgtataaatcagtggtttttaatatattcacaattatattgtacaaccatctcctcagttgattttaaaacatactcttcacccccaaaagaaaccccatgcccagtttagcagttgttccacactggcctccagcccttctctttcccttactcccatccctgagtaaccattaatctactttctgtctctatggatgggcttatttgggacaaatttccatttcatacaaatgaaataataaaatatatggtttttacgactggcttctttcacttagggtagtgttataaaggttcatccatgttggagcatgttttagtacttcatttcttttttttactaatattccatgatatggataataccacattttgtttatccattcatcagtttgtagctatttgtggtgttctcactatttgactattctgaataacactgccacgaacatgagtgtgcagtttttttctcgtcctatgttttcatttcttttgtgtacctacctaggagttgaattgctgggtcatatggcaactgtgtttaaccttttgaggaactaccaagctatttgccgagacatctgcactattttacattcccaccagcagggtatgagggtttctgtttctccacatccttgctaacacttattgtcatgtcttttttgattatagtgatccttgtgggtgtgaagtgttacctcattgtggctttaatgtgcagttctttcatggctaatgatgttgaacatcttttgtgtttattggctatttatatatcttctttggattgctgtctgttcagatctttagcccattttaaaaattgagttgtctttttattattaggttgtaagagttctttatatattctgtgtacaagtccctgttagatacatggtttgcaaatgttttctcctattctgttggttttttttttactttttcatcccttgaagcacaaaaatttttaattttgatgaagtccaatttatctgattttgttgttacttacgcttttggtgtcatatctaagaaaacagtgtctagtcaatcattaaggtttattacttttctgggttttttaaagaattacatttagaggtgtgatccattttgaacaactttgtttttcttttgacacagagtctcgctcttttgcttaggctggagggcagtggtgcagtcttggctcacagcagcctcagcctcctgggcttaagtgagtagctggtactgcaggtgtgcaccgccacacattgctattaataacttttgtatttttattgcagagacagaattccaccacgtttcccaggctggtcttggacgcaagtaacccgcccacctcagcctcccaaagtgaaaaattgctttcactttgcactgcagactcgccctgatcttgtgcaagatccaagagccttctcttggggtctggatcaagacccgttttctataacaatattattagaataacgtttgatttttttttttaagtgaaataaattgttactaaaaaatttgaaaaagaaaagttcattggagagtgacttggtgctcagcccattttgagcagttatttagtataaggtggggttcaaattcattctttaatattaattttttatttctaattgacacataaccatacatttataaccatttttactctatagagtccagattcattcttctgcatgtagatattagttgtcccagcaccatctgttaaaaagactattcttggccagtcacggtggctctcaatgcctataatcccagcactttgggagtcccaaacaggcagatcacatgaggtcaggagttctaaaccagtctgaccaacatggtgaaaccccgtctctactaaaaatacaaaaattacctgggcatagtggcgcacacctgtagtcccactactctagtggctgaggcaggagattcacttgaacctgggaggtagaggttgcagtgagctgagatcatgcactcgagcctaggcgacagagtgagactccatctcaaaaaaaagaagactgttctttccttcattgaattatcttcacatgcttgttggaagtctgttgactacaaatgtgaaagtttattaccggactctgaattgtccttcactgaatctctatgtcttatccttataacagtaccatactgtcttgattagagttactgtattttaaaaggctatactttttcagttagcagaaaacattttagctatcatcacaactgtctgtaaaccttcattaatgcttgacttaaattccaagaaggagcaacataaaaagtcttatctctttaggagttttagtcttattacttttaggagcctgaataaccaaatgtattatttagcctcttactaataactccttgatccgtaggggcataccaagaagaaaagaaatagtttttaaaaaatgagagtgggccgggcatggtggctcatgcctgtaatcccaatactttgggaggccgaggcaggtggatcacttgaggtcaggagtttgagaccagcctagctaacatggcaaaaccctgtctctactaaaaatataaaaattagccgggcatggtgacacatgcctgtaatctcagctactcaggaggctaaggcagcagaatcacttgaatccgggaggtggaggttgcagtgatccgaggttgcattactgggttaaagagtgagaatctgtctcaaaaaaaaagagagtggggaaaaaaaatgtatgccagaacttaaattataattttaaaaaaatagtgaactttctaattgttctcttcagataatataatgttattctcttatgttttattgcgtaccagatgctgttcttcgtgcttgtatgttaaatcttttattgtctaacatttctttcaagcaagttctgtttgtatctgcactgtgtgtattaggcggcttgggcaaagaaaagttgagtaatttgcccaaactcacgtgtctagtaaataacaggcctggctatctggtgtttaagcttctagcagtgctttgaatagtaactaatgcatagtgtatgcctcactgttcaatcagtgattcattagaactaacttcatgacctgctcatagccccagactgcatttgttcacaaatatctgtagtccttcattgaggcagaaataggaataccttgtgtgtttgttgttcattcccttgtgagccatatgcaggctacagatagctttatttgtgtaagatttagtagagacagggtttctccatgttggccaggctggtctcgaactcctaacctcaggtgatttacctgcctcagcctcccaaagtgccgggattacaggtgtgagacactgcgcccggcctgtatgtcttcttttgagaaatgtctattcaggtcttttgcccatttttaattgagttattaaaattttccctattgagttgcttgagcgccttttatattctggttattaatcccttgtcagataagtagtttgcaaatgttttctcccattctgtgggttgtctcttcactttgttgatgatttcttttgctgtgcagaagctttttaacttgatgtgatcccatttgtccatctttgctttggttgtctatacttttggggtattcctcaagaaatctttgcccagagcaatgtctctgggagtttaatgttttttagtagtttcatagtttgaggtcttagatttaaatctttaatccattttgatttgattttttttaatatggtgggacgcaggggtctaatttcattcttctgcatgtggatatccagttttcccagcaccatttattgaagagactgtcctttccccagtgtatgttcatggcgtctttgtgggaaatgagttcacttagacgtatggatttatttctgagttctctatcctgttccattgatctgtgtatcttttttttttttttttgaggcggagtcttcactctgtcgcccaggctggagtgcagtggcaccatctcggctcactgcaagctctgcctcccaggttcacgccattctcctgcctcagcctcccgagtagctgggactacaggcgcccgccaccgcgcccggctaattttttgtatttttagtagagacggggtttcaccgtgttagccaggatggtctcgatctcctgacctcgtgatccgcccgcctcggcctcccaaagtgcagggattacaggggtgagccaccgcgcccggcctgtgtatctttttttatgccagtaccatgccattttcgttgtaataatttgaagtcagataatgattcctccagttttgttcattttgctcagtatagcttttgctattctgtgtcttttgtggttccctgcacattttggaattattttttctacttctgtgaggaatgtcattggtgttttgatgggattgcactgaatctgtagattgctttgagtattgtgaacgttttagcaatactaattcttctaatccgtaaacatggaatctccatgttttctctgtgtcatcttcaatttcaatgttttaaagttttcattgtagagatcttttactcatttggttaagtttattcctaggtattttattatatttgtagctattgtaaatgggactgcttttaaaatttttttcagattgtttgctgttaaatataaaaatgctcctgatttttgtatgttgatttttgtatcctgcaactttactgaatttgtcagttataataggtttttcttttttggagtctatgtttttccaaatgtaaggtcatattatctgcaaacaaggataatttgacttattccattccagtgtggatgctttttatttcttttgtctgattgctctagttaggacttccagtattatgttgaataacagtggtgaaagtgggcatccttctcttcctccagatcttagaggaaagccatttagtttttccctgttcagtatggtactagttacgggtctgttatatatggcttttattttgttgaggcatatttcttctatacccagttctttgagggtttttttgtttttgtttttgtttttgaggcagaatctcgctctgtcacccagctggagtgcagtggcataatctcggcttactacaagctctgccccctgggttcactccgttctcctgcctcagcctcctgagtagctgggactacaggtgccctccaacgtgcctggctaattttttgtatttttagtagagatggggtttcaccctgttagccaggatggtcttgatctcctgacctcatgatctgcccgtcttagcctcccaaagtgctgggattacaggcgtgagccaccacacccagctgagggttttaatcataaaggggatgttgctttttatgtgatataaattatatatttatatcataatatatatttttatatatttatgtcttatataaataatatatatgttttttggtctttgtcttttattctgttaagatgtaccaagtttattgatttgcatatgttgaaccatccttgtcgctgggattacaggcgcgtacgaccactcccggctaattttttttgtatttttagtagagaggggattgcaccatgttggtcagggtggtctcgaactcctgacctcaggtgatccacccaccttggcctcccaaagtgctggaattacaggcatgagccaccgtgcctggcctatctagtgttattttattgtgatcggagaagatagttgatatgatttcaactttttaaaatttttatttgtttgtttgtttgtaacagagtctccctcagttacccaggctgaagtacatgttacgatcttggctcacctgcaacctacaccttcttggctcaagcagtcctcccaccttagccttccaagtagctgggactacaggcacgtgccaccacacatggctgatatttttggattttttttttttgtagagatggggcattgccatgtgtcccagggttgtctcgaactcctgagttcaaacagtctacccattttggcctcccaaggtgctaggattacagacatgagccgctgtgccaggtcaaatctttagacttgttttgtagcttaatatgtggtttatctttgagaatgatccatatgttgaggagaagaatgtgtattctgtagctgttggacacggtgttctgtaaatatgtattggacctatttggtctatgaagcaaattaggtctaatgtttctttgttgattttctgtctgaatgatttttccagtgctgagagtggagtgttgaagtttctgaccgttactgaggtctgtttctcttttttgctctagtaatatttgctttatatatctggatgctccagtattggttgcatatatatttatacttgttataatctcttgctgaattgatccctttatcattatacaatgatcttctttgtttttttttgtagactttgtcttgaagtctattttatctaagcatagctactcctgctcttttctggtttccatttgcatggaatatctttttccaactcttcaattttagtctatgcgtgatttcataggtaaagtgtgtttcttgtaggcaatggttcattgggtttctttttttttggagacagactcgctgttgcccaggctggagggcaatggcgcgatctcggctcactgcaaccttcgcctcctgggttcaagcgattctcctgcctcagcctccccaagtagctgggattacaggcgcctgccaccacacccagctaacttttttgtattttcaatagaggtggggtttcattatgttggccaggctgttcttgaactcctaacctcaggtgatccgcctgcctctgccacccaaagtcctgggattacaggcgtgagccaccgcacctagcctttttttaaaaatccatttaaccactgtatgtcctttgattggagagtttagtcaatttacattcaatgttgttactgatgagtaaggactcaactactacaacttactatctggttgttttgtaatcctacttcctcctttcacccttcttttttacttcctcttccctccttttttcccctccctcccttccttgttttgaaagtgattttctctggtggtatgttttaatttcctgctttatattttttgtgtatctgttgttggtgtttttgatttaagatcaccatgacagccaggtgcagtggctcacaactgtaatcccagcactttgggaggccgaggtgggtggatcaagaggtcaggagttcgagaccagcctggctaacatggggaaaccctgtctctactaaaaatacaaaaattagctaggtgtggtggtgcacgcctgtaatcccaactactcaggagactgaggcaggagaattgcttgaacccgggaggcggaggttgcagtgagccaagattgtgccactgcaccccagtctaggcgacagagcgagactctgtctcaaaaagaaaaaaaaagatcaccatgagggttacaaataacattttataacgcattattttaaaccaataacaacttaaaactgattgcaaaaacaagcaagcaaagagaaaactaataaaaactctacacttcaacttaatctgtccgctttttaactttcgttgtttttatttatacatttattatactatgtcttaaaaaaactgtagttataggccatgggcagtggctcacacatgtaatcccagcactttgggaggttgaggtgggcagatcacctaaggtcaggagttcgagaccagcctggccaatatggcaaaaccccctctctactaaaaatagaaaaattagctgggcatggtggcgggtgcctataatcccagctacttaggaggctgaggcaggagaatcacttgaacccaggaggcagaagttgcagtgagccgagagtgcaccactgcactccactctgggcgacagagcaagactgtcttttaaaaaaaaaaaaaaaaaaaaacacaggcgtagtgactcacaactataatcccagcactttgaaaggccgaggcgggtggatcatgaggtcaggagttttgagaccagcctgaccaaccgaccaacgtggcgaaaccccatctctactaaaaatacgaaaattagccaggtgtggtttatatgcacctgtaatcctagctactcaggaggctgaggcaggagaattgcttgaacccgggaggcagaggttgcagtgagccgagattgcaccacttccctccagcccgggcgacagagcgagactccatctcagaaaaaaaaaaaattgtagttcttatttttgaaaggttcatcttttattcttcctgcttaaaatatgaatagtagtttatatacaattacagtgttagaatattctgtatttttctgtgtacttattgttaccagtcagtttttgcaccttcgggtgatttcttattgcttgttaacatccttttctttcagattgaagaacttctttttttttttttgagacagtcatgctctgtcaccaggctggagtatagtggtgccatctcagcagtgccatcttggctcactacaacctccgactcccaggttcaagcaattctcctgcctcagcctcctgagtagctgggattacaggcatgtgctaccatgcccagctactttttgtatttttagtagagatggggttttgccatgtttgccaggctggtcttgaactcctgaccttagggtgatcctcctgccttggcctcccaaagtgctaggattataagcgtgagtcatcacgcccagcttggtggtttattttcagatagcctgaattcaagctcactaatgttttcttctgcttgatacatttctgctattgagagactctgatgcatttttcagtttgtcaattgaatttttccactttgggatttctggttgattctttttattaataactattgcagtctgtttttaaaatttacaggattctgaatttgttctctgtattatcttggatttcgttgaactttcttaaagcatccagtttgaattctgtcagaaagttgacatatttcttaccacttgggaattggtcactggtgccctttatttttagttcatttggtggggtcatgttttcttgaatggccttgttgcttgtggatgttcatcagtgtctggtcattgaagagttgggtattctattctttgtagtctggttttgtttgtacccatttttttttctttttttgagacagtgtctcactctgtcgcccaggctggcgtgcagagcacaatcgttgctcaccgcaacatccgcctcctgggttcaagcgattcttctgcctcagcctccttagaagctggggttacagtcacgtgccaccacgcctggctaatttttgtatttttagtagagacagagtttcaccatgttggttaggctggtctcgaactcctaacctcatgatctgcccaccttggcctcccaaagtgctgggattacaggcgtgagccactgtgtctggcccccattcttcttgagaaggtttttcaaatattcaaagggaattaagtgttgtcatctaagtctttgttcactgcagccatacatgcattagagggcaccccaggcctagtaatactgtgactctgtagaggtatcaccttggtagtcttggggaagatctgggagaattccctgtattaccaggcagtctcttgtcctcttcccttacatttctccaaacaaatggagtctctctttgtgctgagctgcctggagttgggggaaggatgacacaagcactgctttggccaccatcactggaactgtactgggtctctcccaaggcctgtggcagctattttctggccactgctgttgttaattcaaggcccaagggtgctttagtcagcaggtgaagaatcctgcaaggactgggtctttactttcagtgcagcaggttcccttctggcccagggtgcatctagaaatgccgcccaggagccagggcctgggatcgggagctttaggaatctgctttattttactgagtgggcacccacttgcaagataaagtcctttttactcttctctcacctcaagcaggtgtgtctccccatggccaccacagctgggaatgtgctgggtcatatctgaagctggcacaatatgacatggcaccttgttttttattcaaggcacaagggctctttagtcagctggtggtgaatcctaccgggactaggtatcttccttcaaggcaatgggttcccttgtggcccaggatatgtctagaaatgtcatctgggagctatggcctagagtcgaggcttcagaactatgcttggtgctttattttactgtggctgaactagtatccacatttctagacaaagtcctccctacacttccctctcctctcagagctaagaactgtgagctctggtacctggagttgggggagggctggcacaagcactcccttggccaccctagctggtgtctcagtgggtcacatgtaccccaagtccactggctttgagcctagcacagtaccatgacttgtccaggaatagcggtcctttcaagtttatttaagaccccagagccctttactcatagtggtggggcttaccaaaattcagattctttgttttttttggcagagtttcgctcttactgcccaggctggagtgcaatgacgcgatctcagctcaccacagcctccacctcctgggttcaaacaattctcctgcctcagccttccgagtagctgggattataggcatgtgctaccaccccgggctaatttttttgttttttagtagagatgaggtttctccattttggtcaagctggtctcaaactcctgacctcaggtgatccatccgcctcggctttccaaagtgctgggattacaggccacagcgcccagcccgaaattcagattctcatcactgggatggacaattcccctctgactagggctggtctaaatactccctctgtgggtgctggctgaattctgtcctgtgctgctttccactatgacagggcagcactgagtttcaatgcaaaatcccagtcatttctctctctgtcccgcgagcacacagattctttctccaccccacactgcattttgggggaacggcaggggtgttgcgggggcagttcaagaccatcttccttatcttcctcggtgcctttttccttgataggatgtcaaaaccaggtactgtgatcgcttacctaatttttggttcttatgaaggtgctttcttgtgtggatagttgttcaatttggtgctccttgtgggggatgatcactggagggttctgtttggccaccacgctctgtctcctctcccctgccgtctcttcttttacttaggggtttagaatgtctaactgaccaatatgtacagtcaggtctcattctgaattcatctacttatgaccttccaagcccactaggcccagttcttagtccagcctccatgatggtacctccacatcctaatttgcttccctccagttcatttcgcacaaagctgctgtgttaatctttctgaactataaatctgcccagtactctaccctacttaaaattcctcattgacttcccatttgccttgagaattaaaagccaaagtcctaaaacatagctttttaattttaattttttttttttttttttttttttaaatttttagatggagtcttgctctgtcacccaggctggagtgcagtggtgtgatcttggctcactgcaacctccgcctcctgggttcaagcgattctcatacgtcagccaagtagctgggatttacacgtgtgcgccaccatgcctggctaattttttttttatctttagtagagacagagtttcaccatgttggccaggctggtctgaaactcctgacctcaagtgtttccacctgccgtggcttcccaaaatgctaggattataggtgttagccactgcacacagccctgaacatagcttttaagttcctttattgtcatattccttttggcaagtctatcattttctgactcacttgtacatgtgtgtcccacccttggtccagccattggtgctttgctttacttctttatttttgttatttattttattttattatcattattattttttaatgagaacagggtatcactatgttgctcaggctggtcttgaactcctgagctcaagcagtctgcttgcctcagcctcccaaagtgctggaattacagtgatgagccactgtgcctgggtcattggtgctatccttttactttttttttttttcccgagacggagtctcgttctgtcacccagtctggagtgcagtggcgtgatctcggctcactgcaagctctgcctcccatgctcacaccattctcctacctcagcctcccgagtagctgggactacaggcgtccgccgccatgcccggctaatttttgtatttttagtagagacggggtttcaccgtgttagccaggatggtctcgatctcctgacctcgtgatctgcctgcctcagcctcccaaagtgctgggattacaggcatgagccactgcgcccagcccccattggtgctattcttttatgtgatagagccatcttctctcttttctttggatttttaaacatattcctccttttacttagactattctccatcccaaacacctctcctaaacttctttcacaccttagactagctgaaacttctattaagaaacctttcttttttataggttgttttttctatagaatctcttagcatttactcattttgttgtgaagtgtctgatcttatttagatgacaagtataggaggatagaaattttttcatatttttctcacccagcaagcacaatttctgacatgtggtaggcattcagtaaatattgaactttagaggctaagacatttgagtgctttggtaactggttgtgctatataggtattctgttattgttactttatagtaaaagcattactcttaaagtatgaaaaaagccttaattcaaaacatttcatgcatatagttaatattactttgcttgtgctcatggcaaaaatggattactaaagttatttaagatatttaagtataattgtttcctttatttagttacagccaagttctacttctgaatctatggatcaactactaaacaaaaatagagaggcagaaaaatcaagagatttgatcaaagacaaaattgaaccaagtgctaaggattctttcactgaaaatagcagcagcaactgtaccagtggcagcagcaagccgaatagccccagcatttccccttcaatacttagtaacacggagcacaagaggggacctgaggtcacttcccaaggggttcagacttccagtccagcatgtaaacaagagaaagatgataaggaagagaagaaagacgcagctgagtgagtaaacctggaacttagaccatcctgttactcagttaactttttttttttttttttttaaaggcatttaggtccttccaactgtgaagaatccatctggacttttagactgcttcatacattgcccttagtttacaaacagctagtccaaacaaatgacatcttaagtaaattaggttattgcaccctgtgctactcttctgttcttccccttttttgcaccccagggctagaaaaacaaggcataaattaagaaaagtttttctgtaaatgaacaggagttgaaaaattatcagttcaggagacctatctttactggattccactcattagtcaccctcactgtgctgctaggatgaaaaactgccactgtcaaggagagaagcatgcgatgcttctacttggaattcaaaatatttttcatcagaaacagtgttttagttaatgtttagatttgttaaaatagacttaattctgcacattccatatatttgttaaatggactttcaggggctaacctcagaacttaactaccattgacttaggtgttctgggtaccaaacaatccagttaaagctaaagttttggaatgtagcttattgataaattggggactgcttattcttgatttgaggcaaattttttttagagccatgattttctgcaggtatgttatgtagataatatcttctcacataaaaattacttcatgctagaatattggtatgttgactggtggctcacacctataatcccagcactctgggaggccgaagcaggtagattacttgaggttaggagttgaagaccagcctggccaacatggtgaaaccctgtctctactaaaaatacaaaaattagccagtcatggtggtaggtgcctataatcccagctactcaggaggctgaggcaggagaattgcttgaacccggaaggtggaggctgcagtgagccgagatcatgccactgcactccagcctgggtgacagagcgagactctgtctcaaaaagtaataataataaaagaatactggtatgttaagaagtgcttttaaggatattttataagtagctactgtcttttcagctcaagtgtttgttgattggccaggcgtggtggctcacgcctgtaatcccagcactttgggaggctgactcaggcagatcacttaaggtcagcctggccaagatggtgaaaccccatctctactgggaaaaaaaaaaaaaaaaaaaattagctgggtgtggtggcagtcgcctgtaatctcagctactcaggagactcaggtaggtgaattgcttgaactgcggaggcagaggttacagtgagccaagattgcactgctgcgctccagcctgagcaacagagtgggactctgaaggagaaaataaagtattttttgattgcctttgagaggagcagttgtatattactcagatttttaaaaaattgttcttttatgactatattctttaagggattaaggaattggcaatataagtgcgtatgtttcaataaagaggattagtgatcttctagtgagaacagtttaaatctatgtttagcagtgtttctttttttttcttgagacggagtctcgccctgtcgcccaggttggagtgcagtggtgcgatctcggctcactgcaagctccggctcccgggttcacgccattctcctgcctcagcctcccgagtagctgggactacaggcgccaccaccacgctcggctagttttttgtatttttagtagagacggggtttcaccgtgttagccaggatggcctcaatctcctgaccttgtgatccgcccgtctcggcctcccaaagtgctgggattacaggcttgagccaccgcgcccggcctagcagttttttttaaattgtcaggtatggaagattttagaacaacctaaagtccatgtagatttcactggcctttttttttttttttaggcaagttaggaaatcaacattgaatcctaatgcaaaggagttcaacccacgttccttctctcaggtaggtttattactttctttgaggttatttagtcccctaaaaagaaaaattagtagtccttcttccatacctgtcatctgaattttgttttagtatgctaaaacaaccttctttctttttcttacatggccattagtgaatactttttagacattaaaaaaaggtctttgttttgtcatcagttagatgtgatcttgggcaaatctttgaatttctctgacccagaatttgacaatgggtggctagctaggctatcaggtttataaatatgtcctctgcacctgagggttttgcatcctggattcaaccaaccatggatcaaaaatatagttaggataatctgtactgaacacatgcagacttttccttgtctttattccaaaatgatacagtaaagcatttactttgttttaggtattataagtaatctagagatgacgtaaagtatataggaggatatgcataggttgtatgcgaatacttcacaattttatataggggacttgagcattctaagactttggtatcttcgtagtgtactgtaaccaatcccccacagataccaagagatgactgctattattattctactgagatcataaggtatatctatttttaatttttaaaaacacttccatcagtttcttaaaaatcactgccactgtttttaatattttttaattggcaaagttttaagtttctactgaaacgttttttcttttattgaaatgtgaaaattgatgtgctatgtttttgttttcaataaaaggaaaatagttaaagcaagtaaaattagacagattcggaaaatcagtctttaaattgcaataatagttcatttattaccttgaaataattgaatttattgttgtttttgtagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaagtaagtcatagaatttgatgttcacttagcctccctaattgtttgtatctgacaccaagcactcttaggttttcagtgacttgagggtgtgatggttatgcataggcatttgaaacagagaggcatgcagagattcaatgtgatattaagtataaggacctaaatctgagaatgttttctgtgaaaaagatggtttagatttactttagtttggggtttgttccttttagctgtgggtatgatctaatttttaaatgactaatagagaaaatcaggaaaccttctcatgcctagctctctagcaatataaaactaagagcgacagaataccttgttattatcataggagcctaatgttaattttttttttattctctcaagcctttgtacccaatacctatgacgcccatgccagtgaatcaagccaagacatatagagcaggtaaaggtgagaataatcctgcctgtgtttgcttgtagtttgcatgctgcatgaattgagtaactaagtttataatgaataaatagttgtagtttagctctgactttttgatgaggctatgctttggcttttgatgaacaacattacatagatattcacatggattttacaaacaaaaacaggagaggagagatgcccatcaattgtgattgtatagtatcctcttcaaaaagagtaattggaggccaggtatgatgtctcacacctgtaattttagcattttgggaggccaaggtaggagggttgcttaagctcaggagttcaagatcagcctggacaacagagaccttgtctctactaaaattcaaaaaaattagctgggcatgatggcatatgcctgtagcccccgctatttgggggactaaggcaagaagatcacttgagcccaggaagtagaggctgcagtgagctgtgactgcgccactgccgtccagcctgggcgacagagtgagaccgcgtctcaaaaataaatactggccgggcgcggtggctcatgcctgtaatcccagcgccgaggcaaggcgggtggatcacctgaggtcaggagtttgagaccagcctggccagcatggtgaaaccccatctctactaaaatacaaaaattagctggacacggtggcgcccgctgcccgtaatcccagctgctaggcggggatgaggtagaagaatttcttgaacctgggaggcaggggttgcagtgagccaagatcgtgccactgcacttcagcctgggcaacagagtgagactccatctcaaaacaaacaaacaaacaaaaaaacagactaattggctggacacagtagctccatgcctgatatcccagctggaggaagacttgagcccatgagtttgagagcaatgtgggcaatttagtgagaccctagctcaaaaaaaaaaaaaaaaaaaaaaaaaaagtaattccaaagctttttaatctgaaatctgatttaaatctgaacttaaatttgaagaagagggttcgctacattaatttactagattgctaaccttgctttatatatacctacggttatttccccaaagctagaatttcttttgaagcagaggggcaactaacttcaaccaatgttgaaatcctattagaaggttgtttcggccaggcttggtggctccgcgtgtaattccagcactttgagaggctgaggtgggcagatcgcatgacccgggagttttaagaccagcctgggcaacatggcaaaaacccgtccctacaaaaaaaaaaatagagatcttagccagccgtaatggtgtgttcctcgagtcctagctacttgggagactgaggtgggaggatcaattgaacccagaatgtccaggctgcagggaactgtgactgaaccactgggctccagcctgggtgaaagagcaaaaccctgcctcaaaaagaaaaaaaaagatggatgtttctacattaaaatgagggagttgttgtataatctagttgcataaactagtattttgtgcttgtgtggttaaagagccttcatagaaaaaatcccccatttttcttaaaaggaaatcttttggccaggcgtggtggctcacacctataagcccaacactctgggatgccgaggtgggcagatcagttgaggtcaggagtacgaaaccatcctggccaacatggtgaaaacctgtctgtactaaaaatacaaaaattagctgggtgtagtggtgcgtgcctgggtgacagagcgagactccatccaaaaaaaaaaaaaaagagaaaagagttcttttaatgttggaaaatgctaaagggtttcgtttttgccaatcagttaatttagaatggttaatttctatcagttgagaaactacagaaagtagaataatttatacagaaaacatatttctcagtgcccagtaattgcctttctgacataaagttttcatttttcctgaattaagatttcctcaatgtgttttttgggtgttttgtgtgtgtgtgtgtgtgtgtgtgtgtgtgtgtgtgtgtttgtgtttttttttgtttgtttttttttttgagacggagtctggctctgtcgcccgggctggagtgcagtggccggatctcagctcactgcaagctccgccccccgggtttacgccattctcctgcctcagcctcccacgtagctgggactacaggcgcccaccacctcacccggctacttttttgtattttttagtagagacggggttagtagagacggggtttcaccgtgttcgccaggatggtctcgatctcctgacctagtgatccgcccgtctcggcctcccaaagtgctgggattacaggcttgagccaccgcgcccggccatgtgtgtttgtgttttaattatttattttatttttttgcatacaggatctcgctttgttgctgaggctggagtgcagtggtgctatcatggctcagtgcagccttgacctcctgggctcaagcgatccttccctctcagtcccctggatagcagggagtacaggggcacaccaccacacctagctaatttttctattttttgtagagatgggttttgccatgttgcccaggctggtctcaaactcatgggctcaagctatcagcttggctccacttcccaaagtgcctgcacccagccgattttctcaatgtttgatgtaattgtgatttcatggaattttttttttttttttctttttttttttctttgagacggagtcttgctgcctcgcccaggctggagtgcagtagccggatctcagctcactgcaagctccgcctcccgggttcacgccattctcctgcctcagcctcccacgtagctgggactacaggcgcccgccaccacgcctggctaatttttttgtattttttagtagagacggggtttcagtgggttagccaggatggtctcgatctcctgacctcatgatccgcctgtctcggcatgatttcatggatgttaactaaaaatcttaattttcgttttctcagtatgctattttttttcttttttgccttagaacatatgaatctgttgaaagaactctgcctgaaataatgtaatcagattatagagtttaatcttattttcagggcctgtaaaaattctgagaagaaagtggattttttttttttttttttttttgctaccgttttaatgtaatgttaaggtgttcatgtatcactagaaggtgtagctgttttcagtgattacttaaaacaatgcaatgggaactttttgttgtcgttaaaatataaaagattactgtagtaagagcaagcatgacagtttggctctctgatgggagagtcacattctaactttatggaggtgctgtctttttaatagaaatgatatactcagagggtgggcacagtggcttatgcctgtaatcccagcactttaggaggctgaggtaggtggatcatgaagttaggagttcgagaccatcctggccaacatggtgaaaccccgtctctactaaaaatacaaaaattagcctagcgtggtggtacgcatctgtaatcctagcttctcgggaggctgaggcaggagaattgcttgaacccgggaggcagaggttgccgtgagccaagatggcaccattaactgacttgtttaactgacttcctttgtacttttttttccctttgttgaagtatttaaaacaaatctcagacatcatgtcatttaattcctacatcctcaatgtgtatcttttttaaaacaggaatttttctttggtacccatagtgctgttatcccattttataaaataaatagtaatttggccgggcgtggtggctcacgcctgtaatcccagcactttgggaggccgaggcaggtggatcacctgaggtcgggagttcgagaccagcctgactaacatgcagaaaccctgtttctactaaaaatacaaaaattagctgggcgtgttggcgcatgcctgtaatcccagctattcaggaggctgaggcaggagaatcacttgaacccgggaggcggacgttgcggtgagccgagatcaagccaatgcactccaacctgggcaataacagcaaaactccgtctcnnnnnnnnngaccatcctggctaacacagtgaaaccccatctctactaaaaatacaaaaaattagctgggcctggtggcgggtgcctgtagtcccaaccacttgggaggctgaggcaggagaatggcgtgaacccgggaggcggagcttgcagtgagcccagatggcaccactgcattccagcctgggcgacagagcaagactccatctcaaaaaataaaaataaatgaaaaataaacagatagataggtagatagatagatagatagatagatagatagatagatagatagatagatagatagatagatagatagatagatagatagatagatagatagatagatagaaagaaagaaatattaccagggagttttaaacatacagctgtgtccttgatgattctttgcattgggagatagatagatagatagatagatagatagatagatagatagatagatagatagatagatagatagatagaaagaaagaaatattaccagggagttttaaacatacagctgtgtccttgatgattctttgcattgggagatagatagatagatagatagatagatagatagatagatagatagatagatagatagatagatagatagatagatagatagaaagaaattcagtggtaaccacacatagtcaaatcaccctaattgagtcaagaatatattcttgcagctggtttgttttgaatatagattacatttattgtatctctttgtagttcccctgccttttcccttattgctttgtatcagaagccagttgttctgtggtatgtcatgcattctcaatttttctgttttcttcttgggatgtcattgattacatctgagttcattttgggttggggagacaaatactaaatggttctgtgtgcgttgtatcatatgtcaggaggcacacaatatcttttcctacttttaattacgaaatgattgagagctcaagtggtaataccctgctcccctatcccaccacctccccattgtaagttttcaattaatcttttatctaattcattattaatttaatgcttaacatttttctctttcgggctatggtactcaaattttggtgtgcagtataaacctttggggagagcttgctaaaaacatagattgcttgatcccatctccagattttctgattcagtaggtttggggcataggctgagaatttgcatttctattgcaatttataaaaccacctcccaagtaatgccgctggtctagggctatacactgaaaaccactgcaattgggggtttgtaaagggtgatttctgaattcctagctttcttctgtgtttattagctggaattattctgtaaaggactgttgttttcaattgggagtatttggttatcctgaaataatttgtacaagaaagacaggataaattcttaattgttttcaattttcagagtgaggagttggtgcccttgttacttcccaacagtgcccacaaagttttgcttttgtttttttaaagggtgtatcctctcccaacattcttatttatttattcttactgttttaaaaagtattatgaatgcatggatttttatatattcattgtatcatgtattcttttttgttactctcattgtcccatctttgatgaatgggaacccgttcaagttggctcctgcaaaactttattgccttgattagctatccctccaaggtaccctgatttctttttgctgggaaatagtattttaaaatcattatctggtcattggcgctaattactgttgcagtattgcttctaggcattttccagactaaactaggaaataccactgtaggccaggtgcagtggcacctgtatcccagcactttgggaggctggggtgggcagatcacttgaggtcagaagttcaagagcgtcttggcccacatgatgaaaccctgtctctactaaaaatgcaaaaattagctgggtgtggtggtgtgcatctgtagtccctgccacttgcgaggctgaggcaggagaatcacttgaacccaggaggttgaggttgtggtgagccgagattgtgccactgccctccagctctgggcaatagagtgagacgagaaaggaagaaaggaagagagagaactttttaaaatcagaaatttaaattaatatttccaagtcaagttaacattgtaagatttttactttttactatgacttcatggtttatctcttattcttttacactgaagctttggttactaaaaatagtaactattatgatattgcataacaatttatcacaaagcttagctactaaaacaaacatttcttatttcacacagttcctgagggtcagaaatccaggaatagcttagctgagtggtttctgtctcgtctcttatgaagctgttgacagtgttggctaggattgcagttatccgaaggggtaactggggctagaggatgtgcattcaaattcgaaactgttggttggccacgtgggcttcacagcccctagtcatgacgtggcagctggcttctcccaaaatgcatagttcagagaaacagtcccaaacagaagctgcagcatgttttacaacctaatcttgatagtggcctgtcatcaattatgttctacactgttggtcatacagagtgaccctggtgtacagagtgaccctggtgtacagcatgggaggggactgaaaacaggagttagatcatcaaggaccatcttagaggtctgcttatttacattttcatacagagtatatacagtatcttcaaaattattattatctaattgttagactacagaataaattttgagatgtctttggagtattagtttttctcagtatctgtttcagtaattctttaagtgccagttttcagagtgtgacatccttgttaattccacagtactaacttctaaagttgctaagtgttacatcgacagtgtgataaataggtagttaatccagtcgagtttgtttttcatatttagagatagctattttttcatctgcaaattatttgtatgcttttaaagtgaaaattatgtaaaaagatgccattcatgaaggctgggcttaatgtccgcatgcctgtaatcctaacattttgggaggctgatgaagtgagaggatcgcttgagcactggagtttgagattagcctggacaacatagcaaaaccccatctctacaaaaaaatttaaaaattggctgagcatgtggcatgtaactgtagttctagctccttaggaggctgaggtggaggatcacttgagcccaggaggtagaggctgcagtgagctgttattgtgccactgcactccagcctgggtagcagaacaagaccctatctcaaaaaaacaaagatgcattcagagaagtcttgcttatatcccagtcctgtccacctgtgtcttccctcatcctgtcatctgtaggggatcattacaattttttaatttatccttacatgtttacttttgcacatttacatttgtttattttttaaaaatagctttatttagacattattcacataccatgaaatttatccatttaaagtatactgtttcatgatttttagtataatcttagagttgtgtagtcatcaccacaatcaactttagtaccttttaatcaccaccaaagaaactttgtaccctttagcagttactccccttcgctcccctctttccccctcctccatatagcctaggcatacgaatcttatttttcttctctacagatttacctattctgaatatgtcattataatagtatcatgttatgtgtagccttttgtgactggcttctttcacctgtgttctcaaggatcatccatgttgtgacatgtgatagtatttcaaccttttttttttttttttttttttttttgagacggagtctggctctgtcacccaggctggaatgcagtggtgtgatcttggctcactgcaacctccacctcccaggtttaagcgattctcgtgtctcagtctcccaagtagctgggattacgggtgtctgccactacaccaggataagtttttgttattatttttttgagatggagtttctctcttgtttcccagcctggagtacaatggtgtaatctcggctcactgcaacctctgcctcctaggttcaagcgattctcctgccttgtcctcctgtgtagctgggattacagtggcctgccaccacacccagctgatttttatatttttagtagagacagggtttcaccatgttggccaggctggtctcgaactcctgacctcaggtgatccacccgtctcggcctcccaaaatgctgggattacaggcgtgaaccaccatgcccgacttttttttttctttttctttttttgagatagagtctcactctgttgcccagtctggagtgcggtagtgggatctcgactcactgcaacctccacctcctaggttcaagtgattctcctgcctcagcctcctgagtaactgggattacaggcaagcactaccatgcccagatgatttttgtagttttattaatagtagagaaaggaatagctgggcgtggtggctcacgcctgtaatcccagcacctggggaggccgattgggagggtggagtgggcggatcacctgaggtcaggagttcgagaccagcctagccaacatggcaaaaccccatctctactaaaatacaaaaattggctgagcgtgttggtgcatacctgtaatcccagctattcaggagactgaggcaggagcatctgaatcgcttgaacccgggaggcggaggctgcggtgagctgagatcacgccactgcaccccagcctgagtgaaagagtgagactctatctcaaaagaataaataaataaattttttttttcatgtggccttagattttaatttctcctgaagaggaattgctgtgttggaactgccaaacttttccaaagcagctgcatcgttttgtatttctttcagtaatgtacaagtgttccagtttctccacgtccttataaataaccgatactgtctttggtttgggttttgtccattcttgtggttatgaagtgttattgtggttttttgtatttttgttttgctttgagatgaagtctcactctgtcgcccaggctggagcaaccttcgcttcctgagttcaagcaattctcctgcctcacccttccaagtagctagggctacaggcatacgccaccacaccaggctaatttttgtattttttgcagaaatggagcttctccatgcttctcaggctggtctcgaattcctgagctcaagcgatccccctacttcagcctccagagtggctgggattataagcgtgcaccactgtgcctggcccatttttgtatttttagtagagacggaatttcaccatgttggccaggctggtcttgaactcctgacctcaaatgatccgcctgcctcaccttcccaaagcgctgagattttagacgcgagccactgtgcccagactataggttatctttttacttgcttgatggtgttctttgtaacacggtttttaattttgatgaagttcaatttatctgtttgttttttcttttcttgcttgcactcctgatgtcatatcaaacaaagcattgcctaacacaaggccacagagattcacccctatgaaactcccataaaactcctatgagttttataggttagctcttaacatttaggtctacaatctcttttgaattaatttttgtatatgataggagagtagtggtccaggtttttctttttgcttgtggatatccattgtccctacctcatttgttgaaaagactcctttcctcttgtttatttgtttttgagatggagtcttgctgtcgcccaggatggagtgcagtggcgctatcccagctcactgcaacctccgcctcccagattcaagcgattctcctgcctcagccttctgagtagctgggattacaggggtgtgccaccacgcccagctaatttttgaattttcagtagagacggggtttcaccatgttggtcaggctggtcttgaactcctgaccttgtgatctgcctgcctcctagcactctgggaagctgagaggctgaggtgggaggatcacttgagctcaggagtttgagaccagcctgtaccattaagcctggctaattttagaatttatcttaaagtataaaatgtgaatccagtttatcttgttctaaatgactaagatgttttaaccagttttattagtctgtaatttacatacaataaaatgctcatctttttatgtttacattttaatgagttttgacaaatacatttgctcatgtaactacttgcttcatcagtgaagatggaaaacattgtgcctgttcctcttctctgtccaactgtactttattaccactagctccagttaaccagtgatctaccttcttttcctgtagattagatttatcctctctagatttctttttctttctttttttttttagatttaggtttttttttttttttttacttaaagaaaaatttttatggaaacgtctcattatattgcccaggctggtgttgaactcctgggctcaagtgatccttccacctcagcctcccagagtgctaggattacagatgtgagccacctcagccagcccctagattttttttttaataaatggaatcaaacagcatataacagggatgttcaatcttttggcttccctgggtcacattggaagaagaattgtattgggccacacagaaaatacactaacacgctgatgatagctgatgaacaacaacaaaaaaatagcaaaacttaataatgttttaagaaagtttatgaatttgtgttgggccacattcaaaaccgtcccaggacgcaagttggacaagcttggtatataatttcatatatgtgtcctaaacagtgtagtaatttgagcttcatgttaatatcagcttattcctttttttgtttgtttttgagatggagtcttgttctgtctcccagaattggtctgcaattctattgcctcagcctccgaagtagctgggattgctggcacgcgccaccacgcctggctaatttttgtggtttttttttttttttttctttgtttagcagagacggggtttcaccatgttgaccaggctgatctcaaactcctgcccccaaatgatccacccaccttggcctcccaaagtgctgggattacaggcgtgagtcactgcgcccagccagcgtattcctttttctgctaagtagcatttcattttatgattataccacagttaatttacccattactagtcgatgggcatttgagttattgccagcttgtggctattatgaatgaagctgctgtgagcatttgtgtacaagtatttgtgtttttatttcttttagttaaatacctagaattggaattgctgaggtatggtaagtgcatattttatttttttttaatttattttattattattatttttttttttttttttttttgagatgaagtctcactctgttgcccaggctggagttcagtggcgtgatttcagctcatggcaacctccccctcccgggttcaagcaattctcccgcctcagcctcccaagtagctgggattacaggcacgcaccaccacgcctggctaatttttttgtatttttagtagagacggggttttaccatgttggccaggctggtctggaaatcctgacctcaagtgatccacccgcctcagcctcccaaagtgttgggattacaggtgtgagtcaccacacactgcctggtaaatacatatttcaattaataagaaattagcaaacttccaaagtgattgtatcattttacattccagctgatcaggttcatatgcaagttccaagtgttctgcatccttgccaactcttggtattgtcttatctttttaatttcagtaggtctaatgggtgtcatagggttacctcactgtgatcttaaatgtacatttccctgatgatgactgatgaggagcacctcgtcatgtgtgtgtgtgtttttggctgtcaaccttttttttagtaaatttttcaaatcttttttcattttatttatttatttatgagatggaatctcactctgttgcccaggctggagtgctgtggtgccatcttggctcactgcaacctctgcctcccaggttcaagtgattctcctgcctcagcctcccaagtagctgggattacaggcatgcgccaccgtgcctggctaattttgtatttttagtgtaaacagggtttcaccatgttggtcagactggtctctaactgctgacctcaagtgatctacccgcctcggcctcccaaagtgctaagattacaggtgtgagccactgtgcccgtcctaacgtttctttttgtctcagtgtttctggctgggtgcagtggctcatgcgtgtaattccagcactttgggaggccaacctggatggatcatttgagccgggagtttgagacaagcctgaggaacatgacaaaactctgtgtctggaaaaaaaaaaaaaaaaggaaaaattagccaggcacagaagcatggtcccagctatttggggggctgaggtgggacaatcgcttgagcgaggttgtgaggggtttgaggggtgatggaggtgagatcgaggctgcagtgagctgagattgcaccactgcactccagcctgggcaatagagccagaccttgtctcaaaaaaaaaaaaaaaaaaaatcatgtttcttttcttactgtgaaaagtaaagttactacttttagtaaattattttaagttatttatatattctggttacaagtcctttctcagatacaggtattgtgaatattttctcccagtctgcagtttttttgaagagccagtattgttaattttaatgaagccttatttatcaagcttttctcttaaggttcatgcttttttgtatcataataagaaatcttttacctaccctaggttatgaatgtttttatggttaggtgtatgattgatttcagttaggttttgtgtagggtgtgatgtaaaggtcgagcttcattttctccaccataaatatttactcgatttctctggcaccagcctctgttttccattgatggctttatttttttttttctctttttgaaatcttgtcacccaggctggagtgcagtagtgtgaccttggctcactgcaacctccactttccgaggtcaagcgattctgcctcagcctcctgagtagctgggattacaggtgcccgccactacaggcccagctaattttttttttttttttttttttttgatggagtctcactcttttgcccaggctagagtgcagtggccggatctcggctcactgcaagctccgcctcccgggttcacgccattctcctgcctcagcctcccaactagctgggactacaggctcctgccagcacgcctggctaattttgtttgtgtatttttagtagagacagggtttcaccatattggccaggctagtctcgaactcctgacctcaggtggtctgctcgtctcggcctcccaaagttctgggattacaggcatgagccactgtgcccagctttattgaattcagttgaccatatatgtatatatgtctatttgtgaactgtttcgttgtattgatctttgtatatatccttatgccaattctctctttattgctgttactttgtaatcaacctttaagtcagttcatataagtctcccagttatattctcatcaaaattgttcttattctgcattctttgaatttccaaattttagaatcagcataggattgtgcactgaatctttgtatcagttctgagagaaatatcttcacaatatggaatcttcattgatgtcatcatatactgctccatttatttaagtcttaagtttcaccagtgttttctagttttctttgtatcaattttgtgccactttcttaaatttatcccttagtatttcatctgttttgtgctgttgtgagtgatgttttaaaaacttctgtttgtttattcgtaaatagagatgcacttgattttttaatttgatcctgtatcttgatgcattggtaagcccactgtttctggcagtcctttaagacttaaacatacagtcatgatctaatcaccatgttggtggtgtttttttttttttttttttttggccttattgtactggtgtgttactgaaaaaagcatgagattttgccatgcttccattcttaggggtgaaactgtctttcactattaagcatagagttaggtgttacttcagttcctgatttgcagagaggtgggttttctttttgatcatgaatggttgttggattatgttcaaatacttttttatcatctactaagtatatcatattgaccaggtacagcgctcatacctgtaacctcagagctttgggaggccaaggcaggaggatcgcttgaggccaggagttcaagaccaacctgggtgatataggaataccccatatctacaaaataattttaaaatttgctgggtgtggtggcacacacctgtagtcctaactacttgagaggctgaggaaggaggattgcttgagcccagtagtttaaagctgcagtgagctgtgattgcaccactgtactccagcctgggtgacagaaggagaccttgtatttaaagtgcaagtgtgtgtgtatgtgtgtgtgtgtgtgtgcatggatagacagatagataataatgtaattccattatggtcatacaaactgttatgaaatgtcattttatcatataccaagtgtccatttgtggttgaatttgtttctggatttttcactgcttcactaatctaataggactaccttctcatccactcactgccaagactgatttttttgttttttcagattaccttgaattttgtttatttttccatatgaactctaaaattactactaaaaaaatcagttgcctttttaaaaccaggtgatctttaaaatatatcttaggctgggcccggtggcaggcacctgtaattctagctacttaggagactgaggcagaagaagaattgcttgaacctgggaggtggaagttgtagttgagctgagatcgtgcccctgtactccagcctgggtgacagagcaagactccctctttaaaaaaagaagaaaaaaaaaaatcctacagaaaagataaatctttttacaattaatttgttccaattagggtccaaatcaggcatgcaaattggatttgtttatgtgttgacgtcttttttttttgtgattgtttcatattgtggtaactttttttttttttttttgagatggagtcttgctctgtcgcctaggctggagtacagtggcacaatctcaactcactgcaacctcctcttctggagttcaagcagttctcctgcctcagcctcccaagtagcccagcttttgtatttttaatagagatggggtttcaccatgttggccagcctggtcttgaactcctgacctcaaatgatccacccgcctcggcctcccaaagtgctgggattagaggcgtgagccaccactcccagccttgtggtaactttttattatgaacgttttgagacattaataacctaggccagtcatgtttcattctacccattgtctcttaagctatatgtccactggattattttgaagcaaattctagacattgcatccgtttattcatcaacattttaatgtgtatcttgaagtcagttttggttttgttttttgtttttgagatggggtctcgctttgttgtccaggcttggagtgcagtagtgcaatcatagctcactgctgcttcgaattcctggtctcaagagctcctccctcctcagcctctcaagcagctgtgactacaggcacatgccaccttgccagcttttcttgtcttgtctttcttcttctttgttttttgtctgtttttttgagacagagtctcaccatcttgctatcttgcccaggctggtcctaaactccagggcttgagatatctttctatctcagcctcctaaagtgctgggattacaggccagcactttagtggggtgctggatgagccatcacacccagccaagtgataggtttttttgtttgttttttgagacagagtctaactctgtcacctgagctggagtgcagtggcatgatttcagctcagtgcagtctcgaccaattggactcaggtgatcctcccaagtagctgggactaaaggtgcatgccaccatacctggctaatttttgtattttttgtagagacaaggttttgaattcctgagctcaagcagtctgctcaccttggctcccaaggtgccagtattacaggcgtgagccactgcactcagccctcatagttttaattatagtttttcccttagtttttgtcttcttcgtatctttgtacaatccaacttgtcttgtattttttttcccaccatctgaattttgctgactgtatccctgtgttgatatttaaagtagacttctgtcccctgtaatctttgtaaacggatagtagataatggaggcttgataagattttttttttccccgtgtttcacagatgtatgtactttcagtgagaagtcatgtaatgtaaccagtctttttcctgataggagtagccaatgagttcctagatgttttacctatccaggagataatatttccctttagtgccttactttttttgttgttgtcttttagcagccattgatgataattgtctagcccaagatccattatttccttaggggttacagaatggtgacattctttttctttcattccttcttcaattattacctggaatatttttataaagaaaaactttaccatatccagctgtttggttaccctgaggaagagtaatttaaaatattaatcatttccctttttaaggcagtcttcaaaataatgagttggttttctgttgtcctccaaaggtaaccaatgagatgggtttttttgttgttgattcttattgtcagtataaacttagggatttttttttttttttttaattttttggagacaaggtcgctctgttacctaggctggagtgcagtgggatgatctgggcatactgcagcctcacttcccaagctaaggcaatctccccacctcagcctcccaagtagctgggactacaggcgagcaccaccatgcccggcttaatttttgtgtgttttatagagacagaatttcaccatgttgcccaggctggtgtcgaactgctgagctcaagcagtctgcctgtatcagccttacaaagtggtgggactacaggcataagccaccatggcaggccagaatcacaataaacttataaattaacttgagaagaaatgattgatgtctttatgatgttgagtcttcctgttcaagaacaaagtataccttcagtagcatattaaagtttatccttggctgtatgcggtggctcacgcctgtaattccaactctttgggagtcggaggtgggcagatcacctgaggtcaggagttcgagaccagcctggccaacctggtgaaaccccgtctctactaaaaatacaaaaacaagtattagccaggcatggtgctcccctgtagtcccagctactccagaggctgaggtaggagaatcgcttgaacccaggaggcagagattgcagtgagtcaagattgcaccgctgcacttcagcttgggcaaccaagcgagactctgtctcaaagaaaataaataaataaaaataaagtttatccttaaggttttgtacatttttttcagtgtatgccttaggtaggttcttttttaatgttaatgtaacccagggacttctcttccattgcatcttctaactgattacttatgaagtaccacatatgaaggctactgctgtctgtatgttagtttttaccctgctcctttactaaattccaatcctttgaggtgttggataaaaatatttttaacatttttcaagtaacaggcagagtcaaggacttggtttcttttcttcccctcctgtcccctcccctccccttttttgagacagggtctcacttcttcacccaggctggagtgcaatggtgcaatcatggctcactgcagcatctacctccctggccgaaatgttcctcccacctcaacctcctgagtagcggggaccatagatgcacagcaccgcggctggctaatatttttgtattttttgtggagacagggtctccccatgttgcccaggctggtcccaaactcctgagctcaagcagtccgctcgccctggcctcctaaagtgcagagattataggcgtgagctattgcacctggcctgaggatcatgttttaacatgaaaattggtggagacgcacgatatctaaataatagcaccatagtatacttgactagctttttaatttgttttaaatatacgggaagttaataagtaacaaagtaataatagtgaatagtttaagctcagttagtgagcataattgaacaaactttcatttgataaaagtgacagttttcagtggctttttgtctaccaaaaggaggtgctttttaaatacatgcatccaagataaaatgtagaaaaattttcaggtttacttttctacatagataaaataatttgtaacgacctctcccaaatttcagcaagtcagtgaatgtttagccacaaatttgcagttaattatataatcagttcttaggattttatgaacaagttctgtattctttgtggcttatacctagttgtaagcagtcattccataattcttttcctgaagtggcttggttaatgccacaccagaaataggtcacagacaatagtgctgtaagaaatgtgtgaggaaagaggcacatggaaagtagctagcttgtgctggaggaactggaaaaaaacctcacattggagacgacagttgagctgaattcttaactggagttgtaacagggagaggcccttacacgcagaccacctgtgtggattaagataagacatagagtagtcttttaaaagaactattatttagaaacctgctatatgctacatggtgctgtgttatactgggtttgagaaagaatgggaagtgttacaaggattcggtggtaggaaatgaggaagatagaaagttagtgttggatctgttttggctctttggtcatactttcatttttctcaaaatgaatgcagtgcctgtcccagaaaatatcatatgagaagtgatttcaaaatgctgtaagagtctgttccagggacttgatcaagtctgatggccatgtgagaaagtctctctgaggaagttgctttcaagctgacacctgaaggatgaggcagaattatcccagctgggatttgggaactggtgtttgaggctgaggactagcatgcatgatacgcagacaacccagagtggcagaagtgggagtggtatgagatggcatcagagacgcagatgcagggtcaaatcattcagagcctcctagaccatgtgaacacatgtattatgctgtggatatactgtttaataggcagtctgcttttttttctgcagtaccaaatatgccccaacagcggcaagaccagcatcatcagagtgccatgatgcatccagcgtcagcagcgggcccaccgattgcagccaccccaccagcttactccacgcaatatgttgcctacagtcctcagcagttcccaaatcagccccttgttcagcatgtgccacattatcagtctcaggtaaggctggtagggctaactcttaatttttgtaccatttaaaaaagcttttaatatggtaaagggattttcctttataatttttgcttttgtgtgatggtaggatagatagataaggacttggggaccctttttaatatatattcaaaggttactgatcattgtaacaggttcagaggaaacagccaagaaagatttgagagtttacagttgtttctggaaatctggaaaccatggagttaaaaatcttaactaaagtccgcttggctctatttgcagtattcatgttctttctttattttttgtttgaacacagcatcctcatgtctatagtcctgtaatacagggtaatgctagaatgatggcaccaccaacacatgcccagcctggtttagtgtcttcttcagcaactcagtacggggctcatgagcagacgcatgcgatgtatggtaggaagcactttgtttgtcttttccagtgtgtgtgactcttcttaatttaagtttctgaaaacatactctaagaataacctgaccttttatgacattgagggtcaagaatctgaaggaaaagatgaactcgtttctttgcctgacttgctttataagtcttggcaaatagtttctacttctgtacctggtcttcagatctctctcctgctttaactaaaatgtaatgatgtttataatggcaaagcatctttgtggagaaaggtacctttctcctcttcctcatcagtattatgctttggtatatcctatgacgtgcaagagaattttataataataaaagcataaaagcgttttcagcatgaaaacattctgcttcacaacttgatctgtgggtcacgggcattcgtttttttgtttgtttgtttttgtttgtttgtttttgctgtttgttataatgataatgctatgtttctacatcatgctgtattttaagtggttgaatattatgtaatattagatatattttagacatgattcacactttataaccaatgtaaacagaatgctgaaatgaaaatgagaagtattttatgtaaaactaagcagtatttatatgtgacagtaataagcaaaaccccatcttcattttgtgactaaacagaaaaatttgtgtagatcaacttagcagctgtctaaagtaccaaaataacagatttttcactgttgataatttaaaattaaatgtccacttgtatatcttatgatatagaattaatggattgcttcaaatgtttttcagaatatgcttttaaatagtactgatttcattaagatgttttgttctgaatatttctgagaactgtagtgtcatttagttttcctatttgcatttttggttttttggagtaggggataattttggtttatttgtacagttgaaaagtgtactgctatgagaatgagattacagttacatgcagctacattgacatttcatttttaaaacctcttttaaactttttgaaatactaagaatataaaatttttattttttaagtttagatgtcctgaacaagtatgtctaggcaaaactgagttatttaagaatttacaggctgggcacagtggctcatgactgtaatcccagcactttgggaggccaaggcgggtgggtcatgaggtcaggagatcgagaccagcctggccaacatggtgaaaccccgtctctactaaaaatacaaaaaattggccgggtgcggtggcacgcgcctatagtcctggctactcaggagactgaggcagcagaattgcttgaacccaggaggcagaggttgcagtgagctgagatcgcaccattgcactccaacctgggcgacagaacaagactctgtttaaaaaaaaaaaaaaaaaaaaaagaatttacagatttcaggctggacgtggtggttcacgcctgtaatcctagcacttttggaggcctaggcgggcagatcacctgaggtcaggagttcgagaccagcctggccaacatggtgaaaccccgtctctactaaaaatacaaaaattagctgggtgtggtggcaggtgtctgtaatcccagctacttgggaggctgaggcaggagaattgcttgaccccaggaggtggaggttgcagtgagccgagattgcgccactgcactccagcctgagcgacagagtgagactccatctcaaaaaaaaaaaaaaaagaatttacagatttctggcaaaccctcttcttgagacattactacttttcatatcacctctgtcctttttaacagagtgttaaaagttttaacattctgttggttaatgagaataggacttgggcagcagcaatcatccttcctattacctgtaacccacagcttatgctttcttcctggaggttcttgtctgtcataaagactcactgctgataggaatttgtacatcatcaaaggtgtttagttttataaaacttaagcccagtcttaatttcccacattatcaccttcaactttttattgtggattttacattttaaataaaaaattgtgtgattgctacattttggaaaacatttttttcaagaagcccatccgtaatttaattgtaaaagatactgacaaactgacttggtttattattttggttatgactccatgtcatttgacttgtctttagttgtcttaaccaggacttcatatgcgtgaaaaggcacgattgattcatcatgctggcttttatgcaacttgtatatattttaacaattttccagtttgctaaaggcctaggttaaaagttcattatgattgtttgtacatttctggtgaatacatcatgatttaacaagtggaaaaacatctctttccttccattttttggcatgctccccttggaatcagatgtgaaacttttgagctaaaatttccattgcatttggagagtagatatttgtgtaccaatgcttttgagacattgtagcaataatactgtaatgttaagcagaatctttcttcccatgtgttcattcactgccaacatctggcttcatcttttggatgaatgttcatttattttgaaacagcctatagggtaaatactgtgtttgaggtacgaataattttcataactacttaccagaacatgtccatttgaagagcagtggggccttagaccccaaagtccatttatgtgtgggcaaataggaaatgttgcaaataaaacacagcactagatctaaagtccagtgaaatctggaacgaactagtcattagaaccagttatttcatgccaggagaaggttactcagccaaacatgaactactctcctgcagtttacacaggtggtatttaattgctgtctgtatggaggcaggctaggagcaagggtgtggatttattgtgattatcactagttaatcaagattccctttggggtgcttaagaccctaaaaaggacactaggagctgggcatggtggtttacacctgtaatccaagcacttggggaggctgaagtggaggatcgcttagccctggtgttcaagaccagtcttggcaagatggggagatcccatctctaccaaaaaaaaaaaaaaaaagaaaaagtctagtcatggtggcatgtgcctgtagtcctgcctacccgggaagctgagatgggaggatcacttgagcccaggactttgaggctacagtgagctatgatggcaccactgtaatgcagcctgggtgacagagcaagaccctgtctctatttaaaaaaagaaaacatcagaaagaattgttttgttctatgccatcataagccataatttaatctgcttaagcacattcttcattaaatcttcagtggtttatttgaattattagactttcaaagccttattatatcaaatataaacaaaatttgaagtacattcttataaactataacaaacttacatagaagtgttaattttatactcatcttccctgaaggatttatattttataaatatattaaatatattgccataaattttctcaaaggaaccaaatactttgagtatgaattgtgctttttttaagctacatcctatctaggtttttaaaacatttaatgcaaacagaacgtgcacccagatgttggtgacaattttatgtcaccttttctcattcattgttatggccatagccaaaggcattgaaaacataagaccactaatgactgcaaaatgaaatcctgattattgtttttaaatttttagtatgtttaatacaaatatgctaacattactaaacagttaaattgatcaaataggagagttatttattacattctaaaaaattattgaccttgtactctttctagctatcttagaaagggcttttgtcaaaaacctcatctctttgatgtcttttgttttgttttgttttgttttgttttgttttgagatggagtcttgccctgtcgcccaagctggagtgtggtggcaccatcttggctcactgcaggctccacctcctgggttaacgccattctcctgcctcagcctcccacgtagttgggactacaggtgcccaccactgtgcccggctaattttttgtattttgtttagtagagatcgggtttcactgtgttagccaggatggtcttgatctcctgacctcgtgatccatcagcctcggcctcccaaagtgctgggattacaggcgtgagccaccgtgcccagcctcttattattttttttttccttttctttttctttttttcctttttgagacagagtctcactctgtcgcccaggctggagtgcaatggcgcaatcttggttcaccgcaacctctgcctcctgggttcaagcaattctcctgcctcagcctcctgagtagctgggactacaggtgcctgccaccatgcctggctaatttttatatttttagtagtgatcgggtttcaccatgttggtcaggctggtgttgaactctcgacctcaggtgatccacccacctcagcctcccaaagtgctgggattacaggtgtgagccactgcgcctggcctctttgatgtctcttaatctaactttcatcattgcctctaccccatcccttctaagaagttactttaatttttttttttttttcctatcacatctattctttttttttttttttttttttaaggcagtttcattctgtcgcccattctggagtacagtggcatgatcttggctcactgcaacctctgcctcccaggttcaagtgacttttctgcctcagcctcccaagtagctgggactacaggtgtgtgccaccacaaccggccaatttttgtatttttagtagagacggggtttcaccatcttggccaggctggtctcgaacttttgacctcgtgatttgtctgcctgggcctcccaaagtcctgggattacagatgtgagccaccacgcccagcctcacatctactcctctaattcatctaattttgttttatggtgatgctttgacctttcagaaagagtaataaacttttctaactagggccattaggaagagttagatccagaatcctgttttggtttgtttttggtagtttaatgtagattagtaagataagtaagaaaatacagtaagtaaaaaaaaaaaagtgaaaagcatccataatccctccacctgacaactgccttttaacattttgtgtgtatccttccaggtgtatttaaattcactcatatgccctatccctttatgcagacatgttttaataagaaatgataatattcatgtttatatttttgcaatgttcctaaagttttggatccattgctagatgatctttcaggataatgacatctccattagtaatgttttgcaaaattgtgtgtctattgaattaaacttggtaaatattgtttcattttggtacatgatttatatcaaggttgttcagtagaatgccatgttggtctttttattagataattattttattcctttcacttttaagcaagtcagcatgataacttgacacctaagctaagtacagaagaacagtgtcttccggtttagttctttcttttaaaattctgtaacaatgtttaaagtgcttgtcatctcttataaaaataattatgcatgaatacaaaaagaaattactaatatgtcaacctttccagaaaattcggaaaatgcacacctcaaaaggctaatttacctttctatttcccaaattcagcatgtcccaaattaccatacaacaaggagacaagcccttctttctactttgccagtgagttgggttttttatactaatttttaattgtacagtaaaacactttttaaagaatacatgttaagggtgtagacttgttgaacagtattttccttgtgccagtcaaattattgaaagtatttatatctgtaaataattcagtttttaaaatggaaatataatgcagtttagtaagaaggctggagttaatgaaaaatggagttgtttcagaaatcaatttttgcataccaagcaaatgtgactgggaaatgcctaataatttccttgttcagagaaacttttcctaaacagctttatacatgcacgcacgtatacacacacacacacacaccaagccacaagcttagtataaacttaaaatgtttgtttatattctgataagaagaaatttatgcctaccaggatttttaattgaataggattgatgaaatactaagggaaaaacttttcagtcctgtgcatggctaaaggttttaaatattcaggaagggccgggcacggtggctcacacctgtaatcccagcgctttgggaggctgaggctggtggatcatctgaggtcaggagttcaacaccagcctagccaacatggtaaaactccatctctactaaaaaatgcaaaaatcagctgtgtgtaggggcatgtgcctgtaatcccagctactcgggaggctgaggcaggagaattgcttgaactctggaggcagaggttgcagtgagccgaggtcatgccactccagtccaacctgggtggcagagcgagactctgtctcaaaaaataaaatattcaggaagcagacccctcaggatgtcttgaactcttaagcacaagagatcatgacctctcaggtcattatcttggacagcacgggtcccctctccccacctggcaaaaagtacagaaatggttgctccttcatggagaaagtctgggcagagctttcttttggaaatgaacttgtaaggtacatttttcctattggtagggcaatttgtaaaaataagggccggatgcggtggctcacgcctgtaatcccagcactttgggaggccgaggtgggtggatcacttgaggccaggagttcgagaacagcctggccaacatggtgaaacagtatctctaccaaaagcatggtggcgcacacctgcagtcccagctacttgggaggctgaggcacaagatttccatgaaccctggaggtggaggttgcagtgagccaagatggcattactgcactcaggcctgggcaacagagagagactctgtctcaaaaaaataaaaataaaaataaggctagtctcttggactttggtatttaaatagaaagagtactaatatttgtagaaatcttttagaaatttgtgccattaatattgtcaccttgtatgaaatattgtattctagaggatattaaggattcagattttatgttaggtacaacattttgagttattttggggtgactcaatgtctgactctactaaatgccatattagcatttaaaatgcatttgaccttaaatctttgttaattataccatgacttggtattcaaaaataaactcatacatacatacatacatatgtatatgtgtgcatatatatatattatttatttggtgctaggaaatgttaaatttaatcctttaatagatgctctttaaaaaggagtcttgctgtatgtatatactattttttttttttttttttttttgagacggagtctcgctctgtcgcccaggctggagtgcagtggcgcgatctcggctcattgcaagctccgcctcccgggttcacgccattctcctgcctcagcctcccgagtagctgggactacaggcgcccacaaccgcgcccggctaattttttgtatttttagtagagacggggtttcaccgtggtctcgatctcctgaccttgtgatccgcccacctcggcctcccaaagtgctgggattacaggcgtgagccaccgcgcccggccatgtatatactattaaaggggaaactatgtctgtgattgtagtgtgtaaaaggtagtgtcaatcagtgattttattatgtactcaatttgaggtctcaaatgtagttatcctcaccatcttactgtttctgttagtagtttggtgtcgttttcctggtaagtagctgaaaggtccttaatcattacacctaagccttaattgccttagcacaacttcccttaaaagggagtatcagtactttttaaaagaaactaacagttgggctgctaatttaatttgctgcttcattttcccctgttctaagccattttgtgatggtttggtcaagttgccttttattccccttttggagttttcagctttccttcacttccctttttctgaatttaacatcaaatttacaagttggaagattttgttttatttttaaagtttagcagtgctggtgatctcttatgacttgtgcatccaaagtcaaaatgacaaaacctagtaacaaattaaacacacagctttatgtactgaatttgcttcagtgagatcacagctgaggaaactagttctggaatgtggttagtgttattaaggatttttgactgatcatatatttagaatcttaaatatttatgtcaaggaacactgagtgggaaacttctggactatgtctggaccaaagaagcatatgtctttgattatctttaatccaaaagactttatgaagacttcttaagttttataaatagaagtttaactgatgaataaatcagaattacaaagaaaattcactttatttttaacatctctgggatctttagccagaatgagcatgtataacaaaagcagtgaaataatatgcatgggtcagaacccacggcccttcccgctgcactctccttttccctgactctcctgtgttttttccttgtttaccttatcttggttccttttattattattattatttttttgagatggagtctcactctgtcatccaggctggagtgcagtcgcgcagtcttggctcactgcaacctccgcctcctgggtttaagcaattctctgcctcagcttccagagtagctgggattacaggcgcctgccaccacgtccagctaatttttttgtattttaaatagagacagggtttcaccatcttggccaggctggtcttgaactcctgaccttgtgatcacccgccttggcctccagttcctttcttgtctctcttgtcttccaagctatttttttcattgacttaaattttcttcctaccccactttgtatcactcttacttaactggcctatcaaggagccgaactgtatttttgttatgagtattgatttaaagtataagtttcacatttctcccaatttattattattatttatttatttatttgtttgtttgtttgtttgagacggagtttcactcttgttgcccaagctggagtgcaatggcgtgatctcagttcactgcaatctccgcctcccgggttcaagctattctcctgcctcactctcccaagtatctgtgattacaggcgccgccaccatgcccagctaatttttgtatttttagtagagacgggatttccccctgttggccaagctggtctcgatctcctcgcctcaggtgatcctcccacctcggcctaccaaaatgctgagaagggaaatatttctaattaactttttaaattttgtttgcaatatgtgatacatattttacacatcctttgtgatttttgttcgtcttgtttttaatcaatgccttgcagtttactggtatttaggtagggaaaggattttgtttttgtttttttaaacaaagcctatgtgcattcactcagcttgagtatttgtgctatgcatgcagattagctatagatcagaacactgtattatagtctttaaatattggtaaacttaaattgcagagatgccttttaaaaatgcatagtaaaaatatttcatctttacttttctcttcaaatgatttcaagatttttacatttttccagttgatgaataacttaattatgagacttcatgggcataattattttctatatttattgttactttttaatattcttagtactttgcttagaaggtaattaaacgtgaaatttacaactttttagtacaaaatttcttgaataaagttaaaaaaaaaaccctctgagattctgtactatatctttatgaaccaccatgaacagaatttgggatttgggaattgcttttccttagacagatttagtattgctacaaatgacatttttaagaggctgggttgggggtaggggttagtgctaatggtttaacagtaggggaccatggacaactgtagacatcactatccaatagaacttttggtggcaaggtgcggtggctcacgtctgtaatcccagcactttgggaggccaagatgagtggatcacctgaggtcaggagttcaagaccagcctgaccaacatggtgaaaccccgtctctactaaaaatacaaaaaaagttagccaggcacgcatttggtcccagctactcaggaggctgacacaggagaatcacttgaacccaggaggtggagattgcagtgagctgatatcacgccactgtactccaccctgggcaacagagcgagactccatctcaaaacaacaacaaaactgcgctgtctactgtagtagctgcttagctacaaggggcttttttattattcaaagatcaatttttaggctgggtgcagttgctcatgcctgtaatcctaaaacttcgggaggccgaggtgggcggatcacttgaggccaggagttcgagaccagcctgaccaacatggtgaaaccccgtctctactaaaaatacaaaaattagccaggtaatcccagctactcggaggctgaggcaggagaatcactttaacccaggagacggaggctgtagtgagccaagattgcgccactgcactccagcctgggtgacagcaagactgggtctcaaaaataaacaaacagggccaggcgcagtggctcatgcctataatcccagcactttgggaggccgaggcaggtggatcacttgagtccagtagttcgagaccagcctggccaacatggcaaaacccatctttactaaaaatacaaaaatcagccaggcatggtgatgcttgactatagtcccagctactcgggaggccaaggcaggagaatcgcttgaacctgggagacggaggttgcagtgagccgagatggcgccactgcactccagcctgggcaacagagtgagaccctgtcaaaaatttaaataaataaatacatacatttttaagatgaacgtaagatttttacaaaaacaaacaacaaactcgggttcgaaatttacatcaaatcttttagaccaagtcagtgcctgtacaacttgggggagctggaagtaaacttaatgagtatgatgatgatggagggcctgttaataagccagcaagttagaaaaaaaggactctttcatagactcatgagactgaagctcagaattgttcatcgtttgtacgtttgttctagctcccagaagacattcactacccttaaaaacattcagagaatatgttgccacagttttcttgttaaaatgttctggcatatgttaattcctacagtctggaaaattttcccagtgtataaacaaagctgctgtgtccagtctaaactgggtatgaaggaatattaatgccagctatggcattggcagtggatgcacaggtgatcctagaactggctctttgccttgccctttcctctactaagagatggctttgcatctcgagatgtaactgggctggagagttggtggcccttagtcctacaacacctagcattatagaactgctccatgtgccttgcctaaccctctgcacaccatttacatgggatatacccagagtcatctagtcatctatgctggtgactcggcagccttgcttaccagactgctggagctagggtgcctggtcccaaagctgtgcttgcttctctccccaatcagtcctgcatatgtctgtgttcgctaacatgttatatgaagaatgtgggaaactattttggaatcatttctgtgtatgagcttattatcttgagggattttaggattcatttctcaagagagggctgggaactatgccttgctagagttgtcttgagaacgctctgttctcagctcattgccacatggaggttagttttgtatcatcagtgtgctgtccatagtcactggaagcagtgaacacatcctactctgcttctgattctccacttactgtttttgaaacacatgaacaggccggacacggtggctcacgtctgtaatcccagcactttgggaggctgaggtgggcggatcacttgaggtcaggagtttgagatcagtctggccaacatggcaaaaccccatctctactaaaaatacaaaaattagccaggcgcggtggctcacgcctgttatcccagcactttgggaggctgaggcgggtggatcacaaggtcaggaaatcaagaccatcctggctaacacagtgaaaccccgtctctactaaaaatacaaaaaattagccgggcgcggtggcaggcgcctgtagtcccagctactcgggaggctgaggcaggagaatggcgggaacccgggaggcggagcttgcagtgagccgagatcgcaccactgcactccagcctgggcgacagagcaagactccgtctccaaaaaaaaaaaacaaaaatacaaaaattagccaggtgtggtgtggcatgcctgtaatctcagctactcgggaggctgagacaggagaattgcttaaacctggaaggcagagtttgcagtgagcctgggcaacagagtgagtgagactcatatctcaaaaaaaaaaaaaaaaaaaaaaaatgaaagacatgaagaaatggtttttgtaccaaggtttggcccatgctgcgattcacaaagaattggctttcagttcttatctttattttgacttaaactggcccatcatgttgtcctttgaagttactctaataaatttctttctaaagggctgaggcactcagaagggagtttacttttctatattttataaagcaaaggtgggagatcctccattaagggcctgggaagtaaactgaatggcagaggggctgctgtgattagctgagagagattgtgggccttcggccctgatgatagatccctggccctgccacataccatacacagtgcccacaccccccccaccaccacacccaatgcagtctgtgccctcaggacattgctccagggcagtagcatggtgaggttagccagataatggccttgagctaaagagtgtgcgcctaaaatgcacttgtttgagtagtttctgcctgtgccttcaagttgtgtttttgggaaaacctagtgactgttcagagtaaaagcaaactaatttgattttaatatcatatgtagagctgtattatatgaaccaaatgctagtctgttaagcaatagctacacttattttttcaagacaatggatgatttaaatggagtcacctatagaaattggtagtggcgtgagttatgcattgtaaccatcaagaaagttcagttgatgaagtgtagaggagcgatgcaggttgtcacacatcggtgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagccctgttcaggtaagggcaactcagaggtctgcatggagtggcttcctcatcctagtatctgagtgctttcttcaggtgccaggtattgcatcgtcagaacacatggcatgtccactctcatgaagatggatacagctgtgcccctggggtggttgctttttttaagaatcacatttaagatacatattgataataggtgataggataagctctggaaacttgcgttaatgaaaaatcaaatttagcataaggttcataaggcaaattcctatttgcttgggacttttaaattttaattaaggtttatgtgatgaggttattttcctatgagcttcttgaattatgtttgctaatggaggtaaagactttgatatttgtcagttccctggggcagtagtcttgtttaactttagtatgctcagaagcttctaactgccaggccgagaatcaggcttctgcaccccaaaaaggaatgtccagatgggaggcacctccagccttgctcttaccatcctgtacattcccctgtactttccgttgcccctcatcataggcccacgtgtgcaaagctcagctttgtgagtatcccttggctgcttttcattaaagaagttttcctctcaattctttcctgtcgctttgcagcaccatcagcaccaggccgcccaggctctccatctggccagtccacagcagcagtcagccatttaccacgcggggcttgcaccaactccaccctccatgacacctgcctccaacacgcagtcgccacagaatagtttcccagcagcacaacagaccgtctttacgatccatccttctcacgttcagccggcgtataccaacccaccccacatggcccacgtacctcaggtaaaccagctttagccaactttctgtgaaggccaggtagaatgtgaaggttatcagtaagcagcgagaggctctcccagctaggaaaccctgtgtgtcatgccatttgcctgtctccctttcccgctcaaatatacgtgatctggccctaagggaatgtttgtgtggttttgtcatgggatcagtgaaggtgctgattggtcagtcctttagttttccaactgagaccttaaaaatatctttgactctggaatgcaacccagtccttctttcctttctgtgtctgctttgctacgtctatatagcctcactactctatatatgtgtatatatatatccccctctacacacttatcttggaagccaggcggggataatggccttcacagagtctcagctctccgaggtgactactggggcctgtcaacttgattgttactcacatgagttccagacacatctctccaattgttttccctggttattcatatatctgctttgaccataagttgtactcttgagagggcttggccttggacattggtgcagtgtaactagaagctggaagcacccaggtggtcccatttttcttgaagagcagccctggaagcacttgggagctcacctccagtgtcagctgctccaggtgaaaggtgtgcttgccatctccgtggttgctgtttgcatcagctgctgacaaggtccctgcactccagggcccaggggattgtcttaatgaggagaaggagctgcactgaagttgggctctaacgctggccttgaggccctccctggggctgttacgggtgaattggctgtattagatgtctctgctacttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtggcggccagcgtggtttggtggagtcagcttcataagagctggggtcctgtaggtgtctagcagaggctggtggctaagtaggcatgtgaacttacatgtaagtcagggatccctaatacctcactgtgtttttgtgctgaaagggcaaaaaggttaacacagggaagctcaaatatgccatgtacccatttgaatacgtgagagtaaaaacagcatttcatccaaggctcatcatagtctagaatagtgcacagtgtgggaaaaaggaaacaagggctcttcctggccctgccaaccccctgcagagctggaatccagctagtttgggctgactaaaatcacctttccaatttgacagtgagtgagaccaggttgaacttggtacagagacactgggctggcccagatcttccaggttactcctttccatctcactggagccattaaaaactccaactcctcctgctccatcagcatatctctcagagagtcacgggggcctaagagtctcttttcactgcctggtgagcaggccagaagcagagggagagaggcaaatgaacagaggtccaagtaattcacatactggactgtgacagtctctgcttattaatgtagtaatctgctttcctgtttgaaagggatgttatctgcaaaattgcctcaggccccacatggcagcctgattctgaagcatcattgaatcttgtatgatattaagttgagaaagctacccttggatccggtgtctaatctttgtgaagatcttaccccatatgtagaatacaatgatcagaaatgtcaagggctaggacagcacagccctgacttctacctaggctcacttggtgcctgctccctgacccttccttgcaggatctacccaaaggtgaagcacatcttcaggtcaacagataatctactagagactgtccccagagaacagaactgggccctgaggcccaccattgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaactgcgcatttcccctatatgacgcacccttcaggtgaggcgtgtgtgtgcaggggccgccggggcaccccaaagcattctgctcgcacaggtggaatggcaggcagggccagtgcttcaagcccacatttgagaactagcaagacccatccaggagtgtgcacaggagggactgtgacgatcagtttagcatcagggcctgaggcttccgggagccgagtctgtgtgtgttctgatggtatacaggatttggcttgatgagaagcagcagcagcagcattctgtgtagctgatgcatgcctaggactcagttggccttccttgttatgataggttggacagggcagtgttttccttcctgagtcccaaaagtctgacatgtggggggttattaccatggcagagtttgattgtagctctggagaagatactgctgagaaagcgctgtggatggactggctttgagtgtagcgttagccccagcctatgccctgaccaggggagagcgccctgtgattgtgctctactacttgatggctgccatggcgatacttcacagtctgacctgttattctgaaagcagtactggtgcttggctaatatttggggagggggtttgttaaggcttttttttctaacccatgaacaagtcttctgggagttttacctgaagtggttttacgtctgactggtttgtttctacccacccacccaaccctccccactttggtgcagatgggaggggggaaagcgaattcaattttgagtcttgttcagctagcacgaggatagtttacaatcatgtgctgcagagacactaggctgatgtgtagtgttgccagttttctgtttcaatgttcgcttttctttttacagtacaagcccaccaccaacagcagttgtaaggctgccctggaggaaacgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatatttggaccgagtagaggcatttaggaacttgggggctattccataattccatacgctgtttcagagtcccacaggtaccccagctctgcttgccgaaactggaagttatttattttttaataacccttgaaagtcatgaacacatcagctagcaaaagaagtaacaagagtgattcttgctgctattactgcttaaaaaaaaaaaaaaaaaaaatcaagacttggaacgcccttttactaaacttgacaaaggttcagtaaattcttaccgtcaaactgacggattattatttataaatcaagtttgatgaggtgatcactgtctacagtggttcaacttttaagttaagggaaaaacttttactttgtagataatataaaataaaaactttaaaaaaatttaaaaaataaaaaaagttttaaaaactgatcaagttagtgtgtgtctgtataagctacttctactgtaggatacttaatatcaaagcaggtgcgctaagggtgtgtttttaatatcccggaaggtagctgtcaaatgatttttcttcttcacctttagttctggttcaaggtgtctctagaaaaagacaagactgagctattctctttggtggattagagatctgcttcaggaggaggaaggttggccagagttgggcagcactgaaattccacatcctcgagctggcaccaattctgtaagcttcctttttaatatctcctgaaccaaaatgagtgtcattagctggaagttcccaattcaggcattttcctattttaccagtagggggcaggagacactcagaaaaaaaatgcaataaagaaatccagagggcattgacatagatggactcataagcatttgttaatattcccagattgcagtggggaggacaaagggaagagcaagtatttgggcagggcaagggttttgtagagagaccatggtcttaattgagcctttaaatattgtgacagcaaatcaagattctgaaaactttttaattcacatatagcaatttgtacattatagcaaaatttgcattattcaagaataagttacttgtacagtacataaaacaatacataaaaatttgccaaataccttctgcctataatgatacaagatgaatccactttgttatcacaatgtgctgtatattctaaccaaatacaggatgtcagatgtgtccttgttaatatactcgcaagttcctctagcttgtgggagatgttagagctaacacatttgcagtaagggacttagccctgaatagaaagcatgaaggaatcgcaggcaaccctcagggaagagtccaaggccttgactttaggttaagaaactgttatgtaaaaatagtgttctctggcccaagattttaatgattgctattcctttttcctacggtccagaaatgatcaaaggcagaagatttataccagataaagccatatggattgctggtctaaaattcaaggcaggttagttgacttaattctttggtgctggtgactgttagtttgtaaaagttcaataaagtcagatgaaggaagtgatggtgccgggagctgtcaagctctactggtggggtctgtaattttagagctaactggagggatcatgatgtctactgtccagtttggtgctgagccatggctctcggtagaagttgctggctggggcctggtcgggactagaaggagagtggtgggatgtgctgtgcctatggtgggctagctgcagccagtggggtgcctgccccacactgctgcccaccccttcatcagctgggtctgctcccgcacaaagaaaaggcgttggcttagtgtcacttcttcctagggccatgagagttttttgtcagcatgtatttgagctgtcctggtaactcggacgagtttagaaaggaagcagtctggaggtgggtgctttccaaatctctgccacggaatctgaagttgtactttgcagcctgttagagctgccaagtttgctctacgtggtgtgcctcttggcaccacctgagagatgtgtgtagagaggctgctaagaaatgagtgcccctggtgtgaagacgtcatatcccagatgtttaacttctggctggagggaaggaacttaatttggttcattatctactgggcatctttcctgtgcggaggggagaaccaatgacttttgagctttctcctttaaaaaa

SEQ ID NO: 3 - DNA, 103342 bp, mus musculus
ccgtccgcgtccgccagcccgggtcccatgcgttcgtccaccgccgccgctcagcggcccgcggcgggggaccccgagccgcgccgcccggcgggctgggccgcgcggcgctcgctcccgcggacggcgcggcgcggcgggcggggcggcgcggtggcgtatccctccgccggccctcccccgcgcggccccggcgcccctccccgcgggccgcgctcgccaccctgcgcctcagactgttttggtagcaacggccacggcgcgtcccggcccggctcccggcggctgctcggtgtctgcgggcctccccgccccttcgtcgttgtcctgctgcctctggcccccgcggccacgccggcccgcgcctgcccgcccggcgtccgcgcgtccccgccgcgctccggcgtctcctcctcggcgcgcccggcacccggctgtccccgcccggcgtgcgagccggtgtatgggccgctcaccatgtcgctgaagccgcagccgcagccgcccgcgcccgccactggccgcaagcccggcggcggcctgctctcgtcgcccggcgccgcgccggcctcggccgcggtgacctcggcttccgtggtgccggccccggccgcgccggtggcgtcttcctcggcggccgcgggcggcgggcgtcccggcctgggcaggtgggtgtcagctcccccagccccctccgcgccgggccgatcccgcgccgctcgtcccctcccccgcctcgcgccccgtgaccggccggcttcgcgatgtgccggggggcccgcggaggggcgggaggcgccggcagattccttcgggcttctcgggccgtgtccagcctcccgcaccatcgcgtcccctccccccagacggccaagatggacggccctggcggccccctgcccctcccgggtgtgccaggggcgattggtatcccgccccacccccttgctgcgcccccccccccgatagaagggcggctgagcctgggtgcgggtcgcagggggtggggggatcctctcctgaaatgagcctctttgccgggtggggagtcgggagggaggaggggagattgaggcccagccgccccaggtagggtcaagccgggtgtcctgcatatctatcccccgccccgcagaccctgggaaggtgggcgacggaggcgaggtgggtgccagcggcctaacgcacccatccccctttagatctggggcggcggggttcccgcagcgggccgttcttcccctccccccccccaactggggaaggggtgggagtgcccggctccctccaggcccgcctccctccttccccgcaaggtcccctgcgcgcgggtggtggccgatccgcattgctgttcctcgtccgcggagcagaaggcgcctttgaatagaggtgggcgagggccggactcttgaggtgggttggccgcgggctctggacacgcaccgcattttccctcccaaccccccccccccccggcccagttcctgcaatttttaggggtgaggcgccgcaacagaggagttggtgcgggtccgaaggcaacaactcccgagtgttggcttgcgccctggtccccctctccccttccctgggcccgatctcgttggtaggctggggtgctgtcctgtgtgactggactctggagggtgtgtgcgtgcgggggtggggagtggtgggggtgcttgtcagttcgtatttcacgaactaagaaaatgcttagtgttaaaacggagaggcagatgccaatagactccattccattgtggccggtgtccttaacttgggaaacgccgccgccagagcttaccaagggcatgcaagtccttttcccctgtgcccctgtgttacaggcactactgtgcctccctctggcctaggcctggctggcagggcctggagcagcctcctccttaaatagacatccaggacttaggaggtgggcaaggggatttttcttgtacggagttttcttcttagccgcattgtcctgctgtccgtttccagagagtgttcctctacagcagaagttaacccctagggtgaatcagagccgaggttttagggaattcttctgggaacagtatgttttttactttattcctccacactcccaattttccctaacatgaggcatttcaaaccctgcttagcttgcctcgttcaagttaaaccatcattttatttccccatctctgtgaagttagggttttgtaagttgtttcttttctgtccttgacttttagtgaaaaacgaaaagatacttaaatgtaactttaaggatgcatcctgtttttctttgctttttcatgttttctctttagttatcagaaagtgacgtgtatgtcactttcactcaaatacaaattaaagctaaagttcctaggcttcaccagctctctttaggcttaaacattagatggtagctgagttgactccacagggaggtgagcagggtgtgagtgccagcaatctttttctgcagttgaggtgctgcaaaagtgaaaggcatttcgagtcttccttgcttcaagttctttcacttgaagcctaggtttttttttttttaagagttttcgtccaatactggtactcagaatgtgtgagtttgttctgtacagagccttggttaatgtcattctctcattactgtctctgtgggttccttgtaaatccattataacttgtagagttttgcttttgtgtgtgtgtgatttaaaataggactggctgcactgaggaaaggaggtgtagcattggggttggtgaggtgcttcagggggtaagggcaatcaactgggattcccataccaccaaccaccaccaccaccaccaccaccaccaccacctcagcaggaagcaactgactcctgctgcaagctgtcctctgacctctacacacctgccagggcatgttcccctcctccacagtaaataaacttaaaaaagaaaaggcgtcatgtttgagatagcaaaatgttcttcccagcctagaagctcactaaagcagtctttcacttctgggcctgcccagagcctggagcctaacccagggccttgcttttgctactcaggcagcctgggtctgacttgatttttgtgtgaatggaattttgtgatttttgagaagagttttttcttgtcaacactcaagaggccactttcttagaaaagaactgtgtgtgatcactttttaagaatcttacgggctggcgagatggctcagtggttaagagcgccgactgctctttcgacagtcctgagttcaaatcccagcaaccacatggtggttcacaaccatctgtaacgaaatctgatgccctcttctggagtatctgaggacagctacagtgtacttacatgtaataaataaatcttaaaaaaaaaaaaaagaatgttacacagttgcactggagattctacttcttactcttaactttgaccttttgtgaggctgtgctcttgtgggatcgaggcttcccctttaatcgggagggtttttttttttttttttttttttaaacagtagtgtacctgctaaactaagtttctccctgccggctcggactttggtcttgacgttcctggttttgtggaggtggtatggtgaactttttcatactcggagctttttgtttcatcttaatttttccctagagaaagtgcccaggagtggtttcactaggtcaaggactcttaaggttttatggctctcacaagctgtgccatgctatttctcagaagactcagtgggttctggagccaagaaggcagctctttgggggatgggctctgtggacttgttggatgctcttggggatgttgcattcaacaaggcatgtgctttcatggatacgtttcctggtcgtttctacttttaaagatttatttttgtatgtataagtgctttgcccgtttgtatggtatgtgtgcccagggtccacagagaccagaagaagagggccctttattccctagaactgcagtgacagactgcagtgaacaccatgtggtcctctgcaagagcagccagcctttctaaccctgagccattcatcctgtccctcttgattatgtctctttgaagttttccaggattgttttttatgtgtatggatgttttgtgtgcatgtttgtaagtgtcttcatactttactgatgcccacagagaccaggagtgggctctggatcccctgggatggagttagggatagttgtgaggccaccatgtaggtgctaggttcctctgcaagagcagccatgccgggcttggtgccacatgcctttcatcccagcccaagagatggggcaagtgaatctttggaacttgaggccagcctggtctatatagggagtagacttacaacaagtgctcttaacctcttcagcccttgtatttgaattttacatgagcttgcactgagactgtgtatgaagatgtttgggggtctgtagtgtataatgccagtgcagatccatggtttctgaaggaactgttctaaaactttctggctgttaaaaaattgttaatccttttttatttgtgttattagctgttagtttatgatcacttttgaaaaaaaaagttagcttgtggtgaagcatggtggtaggattaactgaaggaggttgaggcaggaggatcatgagttacaggccagcctgggctacacatgtactgttcagaggtggtgtacacctttgatcctaacaccggggaggcagacaggcagtctgctgctgtaccgagcagccagggctacgcagagaaaccctgtcttggaaaaacaagtttaatttgtttatgcatacctcttgtctgtctggtgcctgtggaggtcagaagaggaggccagatgccctagagctgtagttatggacggtcattgggccactgtgtggatgctgggaactgagcccaggtcctctgcaagagcggccagtgctcttaactgctgagctacctgtccacaaccatgcctttattttttgagttcagatcttttgtatccgattgttcttgtccttgaaactttggtgtgcctgcccaaccccctcccaactgttgggattgtaagtgtgcacctgcctactttatgcagtgttggggtggtcattcagagcttgtctgcatgctaggcacacgttgtagctacatcctcagctcctagttagtgactgcactgggagtcatcatgggttaattcatatccctgccttcctttcctctttattgggtttagtggttcgaggggcagcatctactttgtagaccaggctgctcaaaattttgtttgctttctttgttttgagacaaatttgtagccttgggcttaaaggcttgtatctgtcactcctggcttataggcttagacatttttttaaatttactttttaaaatttatgtgtgtatatgtgagcttgtgtggttgtgtaccacatgtgtgcaggagccctgaggaaaaccagaccagggcactgagttggagatggaggcagttgtgagctgccatgtgggtactgtggactgaacctgtgtcgtcttctgggataggtaagcatttgtaaggaaggagtcagctctcaagtgtgacttgtagcttttgtttttgtttttgtattctttttcagacagggtctcttacacaattgtgacaatcctgaaagtcactgtgtagtcccggctggtctcctaattcagagagatctacctgtctctgccttctcaggtgcactctcaagcctgggttagttttggatttttagttgttgttgttgtttttgacagggtttctttgtgtaatagccctgctgtcctggaacttgctttgcagtctaggctgatctctaagagatagacctgagtgctgggattagaggcatgggccaccattgcctggcttgcctggaactccttgaagcatgcatcttcttgcccctgcctcaggcaccatggcaggctcccacacttactttaaaaaaaaaaaatgtagcctaggctggctcacaagcacatttgggatttcaggtgtgtaccaccatcctctacacttcacactttaaacaccttttttttttctttaaaattacatttgcagggcctggagaaatggtttagtggttaagagcactggccactcttccagtggactggggttaagctccaagcacctacaagacagctcgcaactgtctgtaactcctgttccagggatctgactcccttacacatgcaggcaagacaccagcatacataaaatacaaaataaattacattttgagagagagagagagaatacatgaatgtgtgtgtgtgtgttggtaaatttcacagttgtgtgattgaagatcccaggacaacttggaggagctggttgtgggccagcgagatggaatccaggttacctgccagatgccagaccgggggcaaatgcctttctctttaagccttcttaccaaccctctcactttttaagaactttctctgctttaatcccagcatttaggaggcagaggcaggtggatctctgagttcacggccagcctggtctacagagttccaggacagccagggctacacagagaaacctcatcttggaaaaacaaaacaaaaaaccccccaccaaaacacaaagaatgttctctgatttctcagttttgttttttcagtttttttatggctttaatctctaaagtcattgcatcttagaaattgttcatctcacttccattaaatgtcagagatatctccataagttcatatccctcaagtgcttacagcaccacacagcatacattgttgagtatctgtctgtaaggcagtgttgagttctttccatgtactaatgactaaaccaaaaatatttcctctcctggagtttacattcctcttttgagccttgaagttagcgccatgtgtggccccgactgtcctgtgtcatccctgtcttctggggatttcgggtgtggacaccacacctattttgccttgaccgagaggcaggcagccttagacagtgcaccagtggcctgggattagaggaagcagattaagggctggagagtttgaggaagtgatggatgcaaatttaagtggattagcggagcctccttgaagaggtaacagtggagggtcaggtcctccagccttaaatcttggttgcagttcataaagttaaaactggctcattttgtcatcttttgaagtgatattaatagttgtttgattatgccaatctgaagttagcagaaattaatacttagatcattacagataaactactaaagtaaagagacatgtttttgctgttcttttggatgtatatattttactgggtttatccaaatatgtggaaattagttacctgtgtttgaaagaaacaatgttggggctgctttgagttctgcatgctaaagtctagcaatagagacagttatgggatcaggcatggtggtcttgctttgtctaaatgtgaacttggggtttttgtttctctaattaaacagttgcagttttacacagggtttgggaacttaccatcctgattaagagccacatgatgcagattaaagaacatctcattctttttgttctaaccagcttcatctgtattggaacttcattctagtatagcgctgggtgcatgcacacgcactgtctttagagacttttcccttgaattgtaatgttctattttggctaggtcgaaattgcttttagtattatatagtgttgagcgggtacaaaagtctatttttatagttatttgaagtgatggtgacagcttcagtggagatgtaaatggaatttattaggctaacctgctgctggagtttttgaattggaaatgcatgggggagggatgtagctcagtggtagagggtttgcctagtattcaagaggccctagattgaatactaccttctgtcaagaaagaaaaacaaacagcaacattgatttgaagttgccttgaaaaaaaattaaaaatacatgggtgagtgagtttgaggacagcctggtgtacatagtgaattcccagccagctagggctgcatagctagaccctgtcttggaaaggtggggtggggtgagggaatgagcagtgataagagtgcttgtgtgtttggaatgggtgttggggggccatcactgtaaggggtgcagttgcctgttttggattgtgaccctgagtgacaagccccgtgctactcgcttgcctctgctttcttagttgtcagacacagagtgtgctttcaggaaactgcccatcgatgggtaggaagcttggagttgttggtgaagcctagaacaataaggacacttttgaatccataccttaaaactagtgccacatgatggaaaatgtgattatttatttagggacaaggcctttgccaaggcttgtctagaatctgtggttctcctactttagtttcctgactattgggatatagcaggagccatcatacctaaatgctcttaagtgggaagagagcctcatacttttgaatagtgtgctgcacttcttcatgaggggtgtgtgtgtatgtgtttcttgaagcacacatttagttctataggtgcttgtgccaaaagctgccttcctgtttaaaacaattgagatcctgtagttgtatatatgctatgtctgagaaatgtttggaaaaatagacatgtgaaatatggtatataatatatatatatatatatatatatatatatatgacacagtctgtgatagagatgaacactgtcctggaggcagaacaaatttatttatgagataagtaagctgagtattcacttatttatagatggggttgtttttttgccttataattggaacttttaggttacttccagaaaagcaaaatattgacaggcatgttggtgcaagcttttaattcttggattcgagagacaggcaagtagtctctttattttgaggctaagttctaggccaggcaaagctacaaaatgagaatctcaaataataaaatctcactgggaagcaaagtcaaatactgagagtttttcttttcctttattaagataaccaacattacaggttcatataggatacaaacagagatatggcacataggttttttttcttccctcaaggtaaggtttagccttggctgtactggacctaaaaatacttttaggttattttatgtatttacaagtgtttttacctacatgtatatatgtgcaccgggtgcatgcttgttgcctttggaggtcagaagaaggcattaagtactctgagaatggagttacatagccaccatatgggtgctgggaagaccagctagtgctttttaccactgagtcatctctccagcctcttgttttaattttttattggtgcacatttcttcagcctcttgctttaatttttttagtggaacctttgtgtttctgggagtaatgtatatgaatgcagttttcctggaggccagaaggtggtgtcaggccccctggagctgaagttaaaggctgtgtgtgagctgatcaccttgggtgctgggaattaaatttaggtcctctgcaagagcactcactgggtgctcctaactgctgagccatcactctagcctcatagattagattttgagttcagtagtttgtatcttaaagattttttttttcttgagatgatagaatttagagtatggaaaaagaagaggaaaaaaaaatctttcaaaatagaaagagctaaacctttcagctttgggagattgggcggcttgccaaaagcaactgttgttgattgtttttaattctgcccctcccttccataaatgcagacagataaacaagatggtgggggggctgtgcgggcaacccactagagcagtgctcgcccagctcgtgttagactctgggttagatttctgcccagcaccacagaaaagaaaacgaaagggaaaacacagattggagtttggctcacttaaataagttcctcacttgttttttgttttgttttgttttttcgagacagggtttctctgtgtagccttggctgtcctggaactcactctgtagaccaggctggcctcgaactcagaaatccacctgcctctgcctcccaagtgctgggattaaaggcgtgtgccaccacgcccggctttccttgcttgtttttagtttgtataattctgcataaatgtaatgtgacgtctacttaaatgtttgtcttttaaagggcagggtctcacatcctaggctggcctgacacttggtatgacctatcctaagggaaacgttttttttttattcagtgcttctaggttgccagtgaatcaaaaagcagaactttcaggagcaaatgtcattgagagcaatgacaaacagtgtgagaggaggttgagaaactgcaggcttgtagtcagtcaggagaccttagaaagcacaccctgcgggtgtttgactgagttgatgaccctgggccttaggccctagggcgttactgccttacagcacagtgtagttaacatgctcacagtggtgactcatagtttaaattatttttaatagctttcaaagaagtatttttcaaactgcaggtcataattgattagattatgaaatctttttagttaaagtggtcttggttgaggtggagggtattcctcactgtgcagctctggttaggttgcagtttgctatgttgactaggctggcctctgacagatgtgcctgcctttgcctcccgagtgctggaattaaaggtacgagccagaatgtctggccctacatttttctgtttttgtaacccactgagtccagttggtgttgtctgttgagatgtaggtggatactggcttgctcttgtaaaggtcttgtgcaagtgattgtagctgcagtgatctctcgagtgcaaggaccatgttgtattcagaagacagcatttaaaacacttctccccatcccctgcttcttatcttctttctgcccctatttcatggtgttgcttgaagcctgagaccaggctctaggtgtcctacttaggccaagcactctgcactcacttattttcagcttctgaccaggtgtgagtctctgcagtaactactggccactgcagaatgaatatttgcctgtcaaagttgaaagtagctctgacttttgggtataagctgcagtatttagaaggcagttggactacaagtcacttggcagaacaacagttacattcttctgtatggctatgccctccttagccattggctttgatcaggtttacatcatcacagtgtgagtagttttctggtgcagtagttgaggctagagaccgattcacctcctcttaactcagttaagctgtgagggctgcagctttgttgtttgattgtatctcttggcacagagaaggtgattgtctgtttgtgtgaaggctcagtttctgtgtctagtaagaagtgtttcttagggttttcataaggagcacaagtagggtgggggtgtaggcctgtggtggagtgcatgtgctgccttcatccctggcaccccacacaaaaagtgaggcactgaattctgtttaccttctgtcttgtcaattccttacctggccctccaaaagtcacacagatttgaagctggaaggttctggtggtttttagtactcagttctatttacaggtgaagaaactaagggcaatgatatttgctaagtctcatgttgggctgcataactgatgttagaatgaggtccaccccctgatcccccaaacctaattaattaattaggctactccaggacctcacatgctaaacccgtgttccatccctcctcccatacatgtttcttagcatgtttcctgcttttcttgttctaagtattccagcttactccagagccttaggaatcattacagccacattctttggagagacttaagtggttttcattcttgcctgagtcaaatccagaccattctctttggtagtgagttcctccataggtggaacacacagtattcattcagcatgagctaaagtctgttgctcttgagtttgtcttcttttttttgtttgttttgtttttcaagatagggtttctctgtgtagccctggctgtcctggaactcactttgtagaccaggctggcctcgaactcagaaatccacttgcctctgcctcccaagtgctgggattaaaggtgtgcgccaccacgcccagctgagtttgtcttcttaaatgtagtcttcgtaggctttcccccagttcagttacacagtctcattgaaggagaaagggccagttcctgtgtccgtgcttctctgggaggtttagttcaggtggcgtcagtgcccagtgccttgcattaacagcctctccatctgggggcttcaacttaacagtgagtgctgagataagagcaaagtcacacctgcagtagaagagggttaatgccactaaccaaaacagataggtggctgtgccgctaatgagcaaatttaatcatacccacccaccactgttgttttaaaaatgtgtatgtgcttgaactcagcttattgtcagtgttgtcatactcaggtgcagccacagcacacactgacggtgttacagaagggagcagttactgctgcaaatgcaggtttttttttttttttttaaagattttttaaaatcttatttttattttttgagatgggcctatgaagtcctggctgtcttggaacctgttgtgtagaccaggctggcctcaaatttacagagatccttctactttctccctcagtgtaaaaagattaatttttttttttaaatttgtgtgtctgtttgggggtaccattagagcccagaagaggatgttgcatcacctggcagttgtgagtcctgggaattgaacccaggtcttttgcaagagcagctattgctcttaaactccggggtcatctttctcatcccaagagtaatatttagatagtgaacaatgaagtgattgatggtgcaaggcaggaccttggggaagttagttagagtcttagtttttgaggcagggtctctaactgtggttctcccagtaattttcccgtctcgccctcccaattacatatgtgagccaccatgcagatttagcttttaaatactactccccttgcctccagtaatggggatagggaccagagagtgtgctccaccatggagctgcactagcctccacctagcagagtaatttaaagtgaagacttttgtagctaacctgtgactgctgacctttgttacccccagcctagtgtgtgagctttctagttgtgattgccctgccagcaccttgtgtgctagccctgcccttatttagtaagggctgctgtgcagtggccttccagtgcatttctctggagagatggctgtgcttaagagtcttctagaggacctgggcttaacgcctagcacctacatggtggctgacaactgtctgtaattccagttccagaggatccaataccctcttctggcctacactgcatgcatgttgtgcacatatgtatatgatggtaaaaacacccatacacatgaaaataaaacttaaaaaaaatgtacttccctaatgcccagtaatagtgtgcatctttgtgcttatttataagcctttttttgtatcatctctgattgagaccagcttgcattagagcggggacacagccctataaaacttatgtggtttgtaactggttagttattgactggtcgtggtttcactgtggaaatcatgtgttaaagtcctctctgcgtagtttgtgtttcccagaaattacttgtgccaggcttgaggacagtagtggacaggtgagacccaggtctctcctttgagctcccacattggtgcagacagcagaagtagttcagatgcctacctgtctatggtattcaggcacttgagctagtgtgttgtcttattgaactcttagacagcttaggctacatagtgggggtctcactttaaacccctaagaagggtctagcatatggctctggtaaaggcacttaacctcaaagtttggcgatctgacttaaatctgtaaacccattcctgcaggttgctttctggcctctgtacacatactgtgacaagtatacttcccctcaataaatatatgtaataaatctatttttttgggggtgggggtgggctggagagatggaccagcagttaagagcactggctgcccttccagaagacacaggtttggttcccagcagccccacagtggttcacaactacctgtgactccagttccaggggatctcatatcttctgggcaatccacatacatggtgcacagacaaaacacccattcacataaatgtaattgagaaaaattttttgaaaaagttccttaaaatgttgaaaaataggaatggaagacagaataaattcttcatttacagatgcttttttttttttttaaagatttatttatttatttattttttatatgtaagtacactctagctgtcttcaggggcatcagatctcattatgggtggttgtgagccaccatgtggttgctgggatttgaacttaggaccttcggaagagcagttgggtgctcttacccactgagccatctcaccagcccgctttttttttttttaaagatttatttatttattatatgtaagtacactgtagctgtcttcagacactccagaagagggagccagatctcattacgggtggttgtgagccaccatgtggttgctgggatttgaactccggaccttcggaagagcagtcaggtgctcttacccactgagccatctcaccagcccctacagatactttttaaaaaagatttatttattttatgtatatatgagtacactgtagctatatagatggttgtgagcctttgtgtggttgttgggaattgaatttaggatctctgcttgcttggttggccccactcacttgctcaggcccaaagatttatttattattataaatatgtatactgtagcagggtgcaagacctcattacagattgttgtgagccactatgtggtagccaggatttgaactcaggacctacagaagaacagtcaatgctcttacccgctgagccatctctccagccccagatacggtttcatgtgtaaaagatcctaaggattccaccccagaatcctttggcactaaagaatattctcagcagagtgacaggatgtaaaattaacataaagatctgtagccttccctcctgtatactagtgacaaacttcttctcatgaagaagtcagggaaacttccattcaccttcaaaaacaaggtcggatctgtccagacctcactgttgatacttagtgcctgttttcttttctctgtaaatcatgttctaaagtgctcacgttgatgtctagcacgtatcagatgttcagatctttttttttttttgtgttttgttgttattgttgttttttggtttttcgagacagggtttctctgtgtagccctggctgtcctgacactcactctgtagaccaggctggcctcaaactcagaaattcgcctgcctctgccttccaagtgctgggattaaaggcgtgcaccaccacgcccggctgtttcactatctcttagagtacagttatatgtccccaccaagcatggattcattttgtacctttgtatcagttagaccaggattctttaaaaagatgaatggaggtttgcttctctttccaggttgtccagtgcagcagaaaaggagggtgggcacacaaatactgtgaactgttagccctgctgtggactggaatgacttccttttcagacagggtcttactttgtagctcgggctgtcctggaactcacaagtgctgggattaaaagcgtgtaccaccatacccagctgagtaagtcagcttcctccacacctctcttcacaagacaggttttctttgtgtagctctagctgtcctgagactctgcagtctagacaggcctcaaactgaggtcttccgtcttctgctgggattaagggtgtgcaccactatttcttgtcactcacatgtaaaagtcgagcaattaaaggacccttctgtacccttcagccagttgtagcagcagtcagtcttctacttcagctgtaattccatctgtcatggtgttttgaagggcattaatttttttcatgaggcataagctattacttatgaccagtgggtgaaacagtggaagagacttgaggttactacgtaaagcattcttggtgcaggctggaggagcaaatgcctccatcagccttcctgtctggagaagttgaaggaaaaccttatgctttataagtacagtatgggggctgatacccacacagggttagttcagttaaaaatggagctgtcagaaagtaaagccgtggaaagcctgcaaattggacaaaatagagtggaagaagagaactcactcccataagttgtcttctgaccaccacacatgtgccatggtaacccctccccctttatatactaaattcaaatgtgatttttttttttaaagggctgccgagatggctacagctggtaaggaaaggtgcttactgcctgaagccctgagtgggttccaggcaggacccacatggtgggagaggagaacagactgcaaattaccctctgacctccatgtgcacccctgtacacacgcatgaacacatatgagtgtttgatttttttcaagatggggtttctgtgaatagcctaggctctcttgggactcactctgtagatcaggctgctctcaaacttggagatcagcctgcttctgccttctgagtgctggggaagttaaataccatcccagctaaatacatgtatttaagaaaaaagaaataagggcttagtagttgagagcattggatgttcttccagaggactcaagttcaattccctggtgcccccatgacagctcacaactatctttaactaatgcattgtggtacacagatacaggcaaaacacccatatatatacaaaaagcagctcaggatgagagtaactgaaatgttcacgttacaatagctaagtcatgccagcctcgtctccagtactcactgctgcttgtgccagtggttgtcatatttattgaacagtgtgtggtgtgacatttccatcatcatggtttctgttgggacagcactgggtctgttcttatcccctgggtgtcaagaatcttgtgctatctgccccttgtaaatccttacctcctgatagaacccctttcctccccctgtgttatagatcttcacatggagagaacttgtttaataaagtttagttatagggttactctttaataataaactcaaagtgggaagagcaaagtgactcagctcaagttaactgaaagtgctctgattagatttttatgatgtactcagttgcttctttcctgtgtgtgtgtgttcatgtgtgtgtgggtacttgtgctcaggtgaaggtcacaacaatgttgagtgttgcttacattcttagagagcttagagacagggtctatcagtcattgtccattgtaggactgtcaccagcctgcatttcttcgctgctggcattaaagtcatgtcatcatgcccaactttttatatgggttctgatatccaaacttgagtcttttgcttgtagggtaagtactttataaatgagccacttccccagccctgcctttccttgtaactgctacatacagttttctttataggaaggagaatttgagtttgtcaatacttgtcatgattcacataaactatattgtagactttatttaacaattcaaaatatgctcagccctctacagatcagaaattcttagaagtcaggctggacctggttgtgcgtttatgtaatcctcgctcttgagaggctgaggcaggaggatcaccaaggctttaactactctttgggctgcatagtgagtttgaagcttctccagactaggtagtgagatccatgtcaaacagaaagtatgaaagacacctgtccttccaagtgcttggatgctgaggtcagatgagctgagctttgtgagtttgagatgaacctgagttacacagtaagccagccccgtgtccaaaaccatgcgtattgaatatgtgctgctctctaagcagtccagtgggagcactgcatagatttcaactgctaggtctacttaggcttgcttagagtgtatgggcaatgtctataggccatgtacaaatgcggccccattcactcccacttactcagtgcgtgcatgcatgagtgtgagtgtctaggttagaagtccaggtaggccctcgggtagttgatgtccccccccacccccagctgtaagttccagggagtaatcctgaccaaagtctgtcttggttagtatttaagaaacttgcttcaaatttggcttaaaaagaaaaagttggtacttaggaggtaaaggcaggtggatctctctgagttcgaagccagccttaatctacaaagcaagtgcccaggaggccaggattgatacacagagaaaccctgtcttggaaagaaaaaaagcatgattctgtagctcaggcaggtcttgcttgaactatggtcatgaagtgccgtatccaggagtacatggggtttcacatagctgagtgtaagtaggtagagcagcagagtctaaaggtttacactagcttgtattgtgcagttaccttttgaccttctgtgggtttgcatgtgtgattatgtgtgtatgtgttgggtttgggggttggtatttgtaggccagagactgatgtcagctgacattgtctctcattgagcctagagctaacaagttggctggtctggttggccagtgagttctggaatatgcctttctgcttcctcagtactgggtatacagattgatgccactatgcctggcttttggcttttatgtgggtgctaggtatcaggaatcaggctcccatatattttgtggcaagcactttatctagtgaaaacaaacctggatccttagctccttttttgtttgtgttggagtcaaggaggaagaataaattagcatttatttagtgtttgtttcaaccctaaagagtgtttgtttctggctcttttgggccaggtggtggcgcacgcctttaatcacagcactcgggaggcagaggcaggcagatctctgtgagttcgagaccagcctggtctacagagtttctggacagccagggatacacagagaaatcctgtctggagaaaacaacaaaaccaaacaaaagagattctactctgctagcaatatattaagaacttctttagtgcataatgtatgtgcacacatgtgtgctggcaggccacattcgatgtctagctctgtaactctgatttactcctttgaggcaagctctcaggaaacctggagctaggctggcagtggacaatacccagtgaccttcctcatagcgataggggttgcagctctgtagaaatcagtggtgtagattgaacagtaaatcagctccccaacgtcacaagttttgtgagaatgccttttttcgattaaaaaagtttttttagacggtctttgtatagccttggaacttattatgtagaacaggcagaactcagtttcccctacctacagagttccccttacctctgcctcctaaatgctgggaataatggtatatgccaccatgcctggctttttaggtttgctaatctgtgttgtcccacaagttttttagttatttcttgccttgtttcagatgcttgttgagctcctttagtgaatttctgtcagttacgcttttcatcttcaaatttttttttcctttttaaaaaattatgcatatttctgtgtatgcacacacacgtgtgtgtgtgtgtgtgagagcatgtgtgttaggctggggccctcagatgccagaaagatggtgttggatctcttggttggtggagttatagatggttgtgagttgccaagtaggttctgggaattgaactcagagccttttgaagggcagcttgtgctactgttgagccatcttttcagctcatgtattaagtcaatcaactaattcatttagtattcattttatggcagggttctcactatggttggcctggaaccaggctggccttgaacacacagagatcctctagactctgccttccaagcactggggttaagtgcatgaatacctgcttcccttactactttattgttattgtgtgtacgtttgtatgagtgagggcaggcaggtgctaagaagtgtttgaagtgattaggaccattggtagtaggttcttctgttcgtacctgggttcaaactcaggtcatcgggttcatgaggattgattttacccactggaccatctcactgccagggatttcttttcttttctttgcccaaggccatgcattcaccaggttagcactgtaacatagttgaagccctgctgtctccagtgacttctctttatgtagctttttgatgctgcatggtaagttagcacactgtccctgctgctggtcctgtttgtaatgactgcttttagttttggagtcagagtctttctattgtgtgtattcactgctgcctggtggctcttcctgcctcagcctcccaaactcaggcattgtagctgggggcggactgcctggctacttgtagttttactttttaaactgtattttgggtcacaagaagcagtttgtgttttttgtttttctgcttagttggtgaggtcatgatttcctgggctttgtaatttttttattgaaaaatggatattttagacaataccttgtagcaagtctggttctaggttggagctagggactggctgttactgtttacaatggacagcactacaggaggataaagaaattgtgctattagagagtcttataggactaacacagtgtaatacatagcatagggcccgtgaagttcttaggctgtctaatcttacgggatcactgtgcaaggcagatgttggcgcatggctggaggactagagagaagtcaggccacttcacacctggcttgcaggatgcacattaactgtcggttggatgatattattttttttataattttggtatgaatgtgtggatatgtatgcacagaagtgtgtagagggcagagctcgtccttgggtgctgccaccttgctgttttgaactgtctcagttaccttgtggttgagctaggctgtctctaccaccaactttttttttttaagatagggtctttctgcagaaccctggctgtcctgaaactcactctataggccaggctatataactcacacagatccaactgcctctgcctcctgagtttaggaaatcaaaggtgtgcagcatcacacccggcactacacccggctctctgcaccagtgctgggaactgagctcaggctctcatgtctgcttgtcacgccagcctgggctgtgaccttctccacatactgattggccaaatctgtaccattgaaggacagtttctgagttagaaattagtttttctaacttctcccccgttaccttcccacatgtgtccatcaaacctactagaattacatttcttttgagctcgccaattttctcttagtgccttgaccacaagctggatacttcttttattttttatttttttatttttggtttttcgagacagagattctccctgccaggtgctgggattaaagtctcgtgccaaagctgccacaaaaccaatttaatcgtcaattttctaaaaaaaaaaaaaaaaaaaaaagtcaaattatatgtatatggatgttttgccagcaagtatgtctatatactaagtgcatacttgttgctccctgaggtcagaggaaggtgttggatcctgtggtcctggagttacagttgtgagctgccatgtgcgagctgggtattgaactcagattctttgaaagaatagccagttctttcttttcaaagaaagatttattttatgtgttcaggtattttgtctgtatgcatctctgtgtataccacatgcatgttttcttaaccacgtagacccaattttaatcacttttttttttaatcactttttttttttttttttttttttggtttttcgagacagggtttctctgtgtagccctggctgtcctggaactcgctttgtagaccaggctggctttgaactcagaaatccacctgcctctgcctccccagtgctgggattaaaggcgtgcgccaccaagcccagctaattttaatcacttttaagttaaatatgacacttaaattatatcactgctatctgcattgattttaaacacagtttccatgttcagaaaggaagttttgtatacccaataagcagtggttcctcttttttcccctatatttggttctgggaatcattttgtctttgtgactgaatgtaaggccttgatgcagttgagcaatacttgttttctctgttagcttgtttactttagcatgcttcaagagtcctttgtgttgtaacataccagaccttcatggagttgtaaaatttatttgtgttattttttaacgttttgtgtgtgtgtctgtattgggtatgtggggtatatgcatgtgagtgtaggtgcccgtggtggccagaagagggcacttgccctggagctggagttataggcagctgtaagctgggaattgaactgagatcccatgtaagagcagtaagtattgagccatctctccagctctagagagtttatttctttggatgaatgcagattttgttgtaagccatcatgatgttgttatccatcagtgtgcatttgaatggtcttcccttggtgagtgacctgctggggactgtgtgtgactatctgctgactcacggcttcaggcaagggttttgatataagcccagaacctgaactactggatcttgtgatcattctatttagatttctcccaattactttagtttttatttatttttgatgtatataatgcctttattaatttctttgatgtacagagtgtcctttggttgtttcccactcccgaaactctcttacccgattccattcctgctaaacccctttccccaaccaaccccctcctgtttctgtgtctgtctgttgtttggtgtttggcgtccgctgacattgattagagttggttacgtgagtgtgggatgggagtcactcactgcactgcaggaaaggcactacagcactgaagagaagacctacctcctccagcctttcctcctccttcattcccagtaggtcccaaagagggctggcaccctaggatcccatgtcctgtctgcaggattataggcgtgcccagtcttggacaggtaacccaactgcttaagttcttgagcacaactgcaatgccatatgtacatactctggccttaaactccccgtgccctcccttgtctggtctgtctgaacgtggcggggtgactcacatggaagtcttgttttaggcctagcgctcattctctgcacttggactagttgttagcctctgaccaaggcagagagcagctctaacctataggaatgaacaaaaatatttagagataatttgataccacgtccacttagaaaacaacactagattgtctccgtatagcctgtaactctcctagttgtggacttttgcatagctttatggtatcagttaggcataagcattctcctgtggaacaggctttagataattagaaagtggtaatgccattattgccacataatgccacattacaacggtgtgtacaccttgactggtgctggttgtttggcttgtgtggttcacttcagggctaagattctgttcagattgatgtctttcttcccagcagcttgtggacaccttcaggtagccatgaaagccagccagcaggaggcccctgactgtcacagtgcgctctccttgtcctgcgtccaaaggctgtgctggatttgtctttattagcaaaagttgtactatctagttctggtggcaacagagtgattgagtgattgcaagaacctgaccgacaactctctctgtttggtgtgtgtgtgtgtgtgtgtgtgtgtgtgtgtgagagagagagagagacagacagacagacagacagacactgactgactgaccgactgaccgaccgaccatgcaagtctgtgacggtgctcaggccaggtctctcccaatcacttttttttttttaaagatttacttatttatatatgtaagtacactgtagctgtcttcaaacacaccagaagagggtgtcagatctcatatggatggttgtgagccaccatgtggttgctgggatttgaactcaggacctttggaagagcaatcaggtgctcttacctgctaagccatctcaccagccctctcccactcacttttatggattccagggatgcctttattcagtgagctagctgtctcaacaactgtgtttaatgatttaaggagtagccatgttagccggtggggcacactgtcttccctttctgtcaatggtacccaagattctgattctcccactgctctcacctacttgctaacttctggtattggttagagacggtgccagaaataattcatggcttcctgaaaggtaaatacttcaatccctgcactataagctgccataatgggtgtgaaatttaatttcctaaaaaactagtggtacaaagaatattttattttgccggacatggtggcgcatgcttttaatcccagcacttgggaggcagaggcaggcagatttctgagtttgaggccagcctggtctacagaatgagttccaggacagccagggctacacagagaaaacctgtctcaaaaaaccaaaagaaagaatttttttttttttgaggtagagtctcatggaatgcagactgctcttaaactcattatgaagcagggatgcacctcaattcctgattctcttactccatctcctgaatgctgagtttgcagggatatgccactatatgcagcttgaacatctttttatttttagattaatttcatgatttatttatgtgtatgggtgtctgcagaagccagtaaaggatgctgtttcccagaactggaattgtgagccatccggtgtgagtgctgggatctgttcccaccctggctctttggaagagcatgaggtgttcttaattcacctttgaacatctttttgcagatcattgattatctgggttttgttgttgttggttttggtttttgcttgcttttgcttttgctgtttttgaactaggttattggttttatttttgttaatgaattacagagttcacacacagctcctcctcaatattgaatattggcttaaagaggcatattgtcatgttgttgtcgaagctggtgctaaattactgagctcgagaggatcttcttggggctggagagatggctcagccagtaagagcactgactgctctttcagaggtcctgagttcaagtcccagcaacaaccatctatagtggaatctgatgcccttttctggtgtgtctgaagatagctacagtgtactcatttaaattaaataaataaatcttttttttttttttaaagaagagcacattctttgtcagtctcccaagcagctgagactgtatcatatatcactgccctaggctgactctccagttttacagtgcttttgatatcatatttaagaatccaaagtcacaaccattcgtagcagtcacaccttttaatcccagcactcaggaggcagaggcaggcagatctctgagtttgaggttatcctggtctacagagtgagttccaggacagccagggctacacagagaaatcctgtctcaaaaaacaaaaaacaaaaagcaaaacaaaacaaaacaaaaacccaaagaattcaaggtcacagtgctgttaaggagtttcatgattttagatttcctttttttcttttgaggctggcccaggacttaccatatactctagattgttcttaaattcaaagatctacttacctctgtttcccaagcactgggattaaaagcatgcactcccactcaggtttttctttttttcttttttctttgattcttatgagacagggtttctctgtgtatccctggctgtcctggcactcattttgtagaccaggctggccttgaactcagaaatctgcctgcctctgcttcccaaaggtttttctttttaaatgtgtgtgtgtgtgtgtgtgtgtgtgcatgggtgcccgatgaggctagaagtaggtgttgattccctgggaccagagttacagaaggttgagctgccatgtgggtgctggacctgggtcctctacaagaagaaatgctcttgactgctgtgcagtctccagtcccttccatctgtttgtttgtttattatttagtgtgagggcatgcaggcagacaggcacgtgcatggaaatgccatagagtgcacatggaggtcagagaacacctttctggagtggttttctgtccaccttgtgggtctgggggattgaactcaggttgtcagagttggcagcaggtgcttttaccatctgagccatccaacttccattttatttatttatttttaaagatttatttattttctgtatgagttcaattcccatgtggttgctgggaattgaactctggacctctggaagagcaactggtgctcttagccaccaatccatttctccagtcccccatttatttcctaaggaaatcttttttatgttgaatggatcacattttagatttagctgacaaatgcagcctaccagttggtggttagaatctttttttttttttttttttaaacaactcagccggatcctccaggaaaggtttttttttttttttttttttttttttaatttttttttttttaaagatttatttatttatatgtaagtacactgtagctgtcttcagacactccagaagagggagtcagatctcgttaggatggttgtgagccaccatgtggttgctgggatttgaactccagaccttcggaagagcagtcgggtgctcttactcactgagccatctcaccagcccggtggttagaatcttttgtgcttgtgtttttctgtcctgctagatatgggtgcttgatgggcgtcttttgtagcacttggtgtctttaagggatttgcaggaaagtagacagactggtatgatgacccttgaacacctgctacttcaacacttagcaagtcacactggtcttgcttcatataccatctatttccttcttcctgttactctgaagcagtgtagaagttattttacgtgcaggttttcttgtgttaatatagccagcattgtgtataggtgtgtgtgtgtgagtgcacatgtgagtatgtgcacaagattccaggtccgggaggtatgggtgccctggagctggtgagatggttgtgagtcacctgatgtgggtccagggaactgaactctgtcaccgtcaggaagagcttgaagagctcttaactggtaagctgtttttccagtcctctactctcctcctttcctttcctttcctttcctttcctttcctttcctttcctttcctttcctttcctttcctttcctttcctttcctttctttgagatagtgtaaaaaaattactgtggttgctctggaacttttatgtgtgtgtgtgcacgcgtgcgcacgcgcacactcagggtggtgggcacatacttgaggtcagaggatgatttggagtaagttctcttctatgatgtgggttctggggattgaactgaggtcatctgtaagtacctttgcctgctgagacattttgctactctgtctttaccatgtttgagagttagtgtttgttttagattgagcctctctggttgaaaaatgccagaaagttcacaggtcccaaagtctgaatgtgttggtgccagcatgatgctacaagtgggaagttctgcaccaagccaaaggcaatgtggtcagaatgtgtggccacttaaggttctgaatataggcaccttcagcttatgtgcacagcacaggtccatatgaaacattaaacttgggttccatcccaagatacctccttagtctaaagtccaaagaaattggaaattcaaaatccaaaacctttctattccaagtacttccaataaggcgtacttaagttaattctttgaattagatagatgattgggtctagtgctagtgaagaaacggagagctgggaatgtaactcagtgagcagatgctcgcataggatttaggaggagccggaatgtgtcccggctttggacgttgtggtgctcacctgtaatcccagcactcggatggtagaagcaggatcaagagtccagggttgcctctgctacataccgacttcagggccaacctgaggtacattagactcatgtttccacacccccaaagccccccaaactaaaagtaagtgggtcgagacccctatggacaggagtgccgaatgacccttcattcactttaaagaccattggaaaatatacatctacattactatttgtaacaactgcaaacttacagtagtaaattagtaaggataataattgtatgtttgggcatcagtacaacatgagaactgcattaaagggtggcaacattaggagtattgagaaacactggtctaggtgactggaagggggtttggtttgcagagcttcctttgctgcacctcagtgaccctctctgacatgtctgacttgtaggtcagttttggttggtgggtgtcagctctttgacactttgctgctgtgtaacaactgggactttttgttttccttttgaactgtctggttctgagtaaactgggttgcccagcaattgctatgtagtactcaaagctgtagttataggcagcaaagagatgatatgtgtgccttctgtcagggccttgttactttagtttactcatagctttgtggagaagtcacccatgttcagggatacttagtgctgtctcagcaatcaggaaaagaaaactctcagcaaggcacagctgtttcatcttttctgtgtctgttttcagacagggagtcactgtgtagcttaggctgtcctggaactcaccatgcagaccagcctggcctctgcttgaatgctaggattaaaggcatgtgccagtatgcctgactttcattttcatcttttaggaacattctgtgaataaatggaagtaagagctgagttaataattgaaaaggtggaggaaatcggtaagacatagttgtaaaattggacttttaaatttttttttgtttttttgagacagggtttctctgtctagctctggctgtcccagatcttgctctgtagaccaggctggcctcactcacaaaagatctgcctgcctctgccaacagtaaaattggatttaaaaaattttatttttactatttttaattttgtgtgtgtctgctttggataatgtgcatgttagtgtaggtgtccacagaagccacaggtgttagatgctcgtggagttgtagtcacaagtagttgtgagctgctcgatgtaggtgctgggcattgaaagagcatcttctcccagtgctcccagccactgagccttctcttgactatcaaccctcactttttgagacaaagtctcattgtgtagccttggctgtcctggggctcacttagaaaggccatccttgtcttgaactcagagatcctcctacttctacttcctggggctaatgacaccataccagtgaatatctttttctttttgatattataataggattaaataattccctttccttttccaacttctcctcccttgcctattctccttgctccatttcaaattcatggcctcttttttcattaattgttatttcgtgcatatatgtttatgagtatattcctaactataacctgatcagtctgtatgtttctcacatgtatgttttcagggctgaccgtttgtcattgataaccaattagtgtacactttcctggagaagactgtttctctcactcttagcattcctaagttgtctgtagttcttgtataagccttgtgggttttctcccatccactttgtgtctatcagtgttgtctcctctcatgttaaggcagccatgttggtgagacttttgacattactaggagacacaatctcacagcagactccctgattctttggttcttacagtctttctgctttctcttctgcaatgtttcctgagccttaggtatgggaatgttttgtagatgtatctactgggactaggctccataatgctgcattttgatgggttgaatgtttttgtaatggtccccctgtctgagaagtttcctggatgaggtgtgaggactacacttatctgtggatgtaaggacaattttctagagttaggggttctgtgattctctgaaatctgacttcacttgcactgagtagttggctaggtttccagtaccagggcatggtttttctctcactgagtggctcttaagtccaattagagagttgttggttactgccaaagaatgccactactgcaagccttagggtgatcacgtcatgccggtcattgtggttcataggcatcatagctgagtaggcttagagttagattgctggaagctcgcctcctttgtaagcttgcacagtggcaccgtgaaggctagtccttaaagggtgcaagcattcaggtcagttccagctcaggtgcttgtgtgtgggtcctgactctaaagtacatggtgtcttcagcagtagagacttacttatctcccacctctggggtcacccaagggcagtagcaataggctgtatgtttaggagtctgggtttttttttttttttttttttttttgttaggttgcctttgactcttggagaaagtgttgtcagctcagatgaaactctgtatgtaatcccctctctcttcctctgttagttaccctcttaaagattgccccacccctcaccatttccctattatgcccagctcttgttcccctcccccacaccctgccaatggtcattttttgtttgttagttttctgtttgttttttgaggcagggtctctgtagtcctgtctgtcctcagattccctatgctgatcaggctagcctgatgacagaccctcctacctgtgtattttaaacactgggattaaaggcggcttcagtgggttcctttttactgtcctggtttctgaagttactccagaatatactcacatgtgaagatttggaacctggcttctttagagataagattgcaggtgtgtgtcactgttcctgatttttgtgtggtactggggataaaaccagggccagttacagtctactaatcagcctgccttttaagtcttaattgtaaagtttgaagggtgccaggaagtttttgggttgtgattcccaagagtgaaaaagcataacccagaaacaaaagcttcgacgtagattaggtgcacctagttgcagcaggactttactgcatgtgaactgggttgggtggtttgggttaaggttcatgtccatcaactgtcaaacagtggttgatcagagtccagtgcataacattgtacttggttcctagcaagatctgtgacaagtgagaagtcaggttctttatgcttttggcccctccccctccccctccccctccccctcccctcccctcccctcttctcttctcttctttcttttcttttcttttcttttcttttcttttcttttcttttcttttcttttcttttcactccagactggaatgtacaggtcagaggactacctgtgagagatctctcctttaaattgtgggggtccagaggatggaatgcaggttgtcaggcttggttgcaagtgcctttaactgctgagccattctgccaggtgccaagaacattgcaaatgtgtgaatcttagggttctagaatttctgaaagaaatgagaggccatccagcctcagacagctttcctgagtgagtgaggtgaggaagacagttgaagggtggagaactaggtagtgggctgcctgggagttcctgctagtgtgctgccacgagttggcagccctgctctaggctttcacctgtttactgaattttcaaatttggactcaattggagtgtgtggctattgtattaaaatggcacttcaagggctggacagaagacccagtggttaagaacattggctgcttgtgtagaggacctgggtttgttttctagaactcacatggctgcttataattttctgtaactccagtttctggggatccagtgtgctgcttcaggccctgtgggtatcaagcatgaacaaggtgcacagacatacaggccggtgctcagctacatagaacatttaataacaaaaaaaccccagcaactttaaaatgggattccagatgtgttgttccacaacaggtggaacagaaatgtagaattccttgttatttgtgagaaactcaatctttccctttagaagaagccttcagttgtacaggtttaagacttgcaggttgaactaacagtgggtagaaaggatcgggagaaactgtaccagcaaggactgtgggtcatgtttttttccccttgtcattctctaaataatacagttgtgtatatgtaacatcttcaattgactagatattaaataataaatgaggtatgtgggtcatgcaaataccatataagtgatttgaacatcattgaattttggttctgatggaatcttgaaccaatcccctagagtacagaggaacaatggtgttatttattatgattcagttcacttgaaaatagtccacattacaaaggcaccatttgatagcagggttttatgttgtttaatgtgggttttgtttgtttctgcagtgctggaaactgagttgagggctcaaaaacaataagcaagcagactgtagtccccccccccccccagctgaggacctctgaggcaagcactctacctcgacctaaatctccaactcctaagcaagcatactctactgcaagctatattcctaacctggtagctgagttttgtgtactgtagcttttccaagggagaaggttggtaaggaaaagacttgttggacaattcctgaattttgacagtgtagcccaggctagcctcaagtaaggaagctactgcctcagctggggttacagctgtgaaccaccaggcctgcaatatcatgtaccaaatctgacagagacacatggtatttagaaataaaagtgtttagaactatctgatgtttaaacatttattttccgtgtgtgtgtgtgtgtgtgtgtgtgtgtgtctgtttgtgtgtttgtcccagcacacatgttgtagtggtcagaggacagattgtagaagttgggatgggaagttgtatggatgctggggattgaattcaagtcttaggcttgcagcaagtccctttaccttctgagccttctgacaaagccctgttttaacttatttttggtagttttttctgcagttataaacacctagctactttagagatggggagaatgagagctgattggggtgtcagttggccatgttgatcacaagtctgtgccaccactccacacttctagtgctgctcctttgcgtacccttgtccttcggtgcgtctggggtggggagacaaggtgtgctctacagccctggctgaactcacaccacagcatcccactgtctcagcctctgaagagtgagtgcagccacacaccactagacccggataggctgtctttactcttctgttatacatttgtttttgtttatttatatattagggtcaaggtctcgctcagctctggctgccctggaattcactgtgtagagcaggtgtccggcttccatctccctagagttgggatcaaatgcatgtggttctccacctgccttacctatttggttttgagaaaacagcagtcttgtcttttctttcctctttgtgggattctctcctggcctggtagcacacagccactgagatttcctgtcacactatattagatggcgccttcacagtcagcttggcctgtgtttgagtagaattataagattatattttatgtactcattaatttaaataaaataaaaattgaatctaataaaacaatgtttaatctttgcagaggtcggaacagtagcaaaggactgcctcagcctacggtgagtaactttaatgttatttagaaaaatacataaactgtgatttccaatcatagactcaataataaagcaaagaattagatttccagttgtactacagatagtctatagataagtcagtttaatacaaggttgttgattcgggaaggcctctgaaatgaacacttttctgttagtggtatttgtggcttacataatactgatgtcaagggttttgatgttccaggaccagagtttgcagagttctctgggctttttgttaggattaatgtgctgtctgttttaactcagtcatttttcctccttggaaaacaccttccggcctgccgttttccaacttttatcagtgaagttaaaatagacacaaagagcatgaaattccatataagaagccctcttttattggtgttttttttgcttggttggtgttttggttttctgagatagggttttctccatgttgttaactgttggaactcctgtagaccaggctagcctcaaactcagagaaatctgcctgcctctgcctcctgattgctgaaattaaaggtgtgaaccactactgcctacctgtttgttttttggacacagggtctactatgtagtcttggctggtctagtacttgctatgtagaccaggctagcctcaaaaactcagagagaactggttgtcactgagttttgaaacatggtctttatcgctcaggctatcttactgagagtcaggtggtcacaccctgtgtagtccagcctggaatggttttgttgccttgattcagacatgttgagagaagctggtcgtcgtgcaaggtgtaccctgctcagcacttctcttctttattaagatgtactgcccctctttaggacttgggttgggaggtctttcctcactaccctgctacccttggtgctcaggctctttaatgtgttagggaagcgctctgtcatccagctgctctccagcctggctgatgtttggttctgttgtggcttatatttagttttatttagtgtgggggtagtgggtgcaccatgatgcaggtgtaatagtcagaggacctccatgtgggggctgaactcaggacatcaggctcatgtgccttgacccactgaaccattttacgcgccccatctgagggagtgtgtgtgtgtgtgtgtgtgttttgagacaaggactaaatatgtatcctggctggcctgaaaacttcctgtgttgatcaggatgacctggaattcacttagatccacctgtttctgcttccagaatgttggaattaaaggtatttacaggcatgcctggctgtatcctacagccactactgcacaacccttctctacctggccgctagctgtgcaaagcacagaccctacaaatactgatttgtcttctccagaggtttttgctttctcacatggaggtctgagtctcctgtttttgtttgttttatgtcatagtaattattagttggaatggttggttgatttgtttaaaactctaccttttctcgtagggaaacaaaatgtgatagtaaccagctcttccttcgtgcattataatccaaatatcttagagctagacaaggttagcttttgtatataggcaagtacaaagatcagcttacaataatgtttattttttatacattctagatttcttttgatggaatctatgcaaacgtgaggatggttcatatacttacgtcagttgttgtaagttacctgattattggggataaactcctttggagtgggattttacatggagttaacatgtagataattcttaacctaatattattaggctatattaataaagatggttttaaaaacatactagaatgctattcagttaattacaactcacagtaaaaatactcttgttaactctgttgcatgtaaaatagtatttatagctgctggtcttttgtgtgatattttgttatctaatggtagtggggacagaagtgtgtagctttaggatacagtttatattcactttggagtttccagtcctgtaccaatagagaagtaggtataatgttaatgtgctgaaacttgatcattgccagtcaatatccaatactgaatgagaccttacagaaaatgaaagggagacacccactatgggaaccacactcttgactctgttaaattgtgtcttttagggatcgaaatgtgaagtacaagtgaaaaacggaggcatatatgaaggagtttttaaaacatacagtcctaaggtaattcttactaagtattagttcttcctgtagcttcctgagagtgtcttgtcattggttgagctgactgtggagttggcagttgagctcatgagataaaatacaaatgttttcctgattaccacgctctctacctgtttgataaccacttgtttttttttttttttttttttcctctctaataacaaattcttactatttaatgactggtttgtgaagctgaaaatattgtatgtgcttgtactggctggttttatgtgtcaatttgacacaggctggagttatcacagagaaaggagcttcagttggggaaatgcctccatgagatccagctgtaaggcattttctcaattagtgatcaagggggaaaggccccttgtgggtgggaccagctctgggcttggttctataagagagcaggctgagcaagccaggggaagcaagccagtaaagaacatccctccatggcttctgcatcagctcctgcttcctgacctacttgagttccagtcctgacttccttggtgatgagcagcaatgtggaagtgtaagccgaataaaccctttcctccccaacttgcttcttggtcatgatgtttgtgcaggaatagaaaccctgactaagacagtgcttatgattttcaaccattttcagatgttgtgagctagaagagggctgtacagagttatgtcttttttgttgttgttgttgttttgagacagggtttttctgtgtatccttggctgtcatggaagtcactctgtagaccaggctggcctcaaactcagaaatccacctgcctctgcctcccaagtgctgggattaaaggtatgcaccaccactgcccggcatatgtcttttttaacattagtgtgtttcagatccgctatagtaagatcagcttttagatttgagggtttttgtattgtaggtgcatgacaagtccaaacaggatgtgataatcaggttttcacaggatgcttttgtcataggcttaaaagtaaatggctttgatgagctaaatagctctataaatggctattaattaatttttttaatgttattaatttctttattttagtgtgacttggtacttgatgctgcacatgagaaaagtacagaatccagttcggggccaaaacgtgaagaaataatggagagtgttttgttcaaatgctcagacttcgttgtggtacagtttaaagatacagactccagttatgcacggagaggtaggcttgggtttccgaggtgaccctaaccctggtgtgattggctcactccaacagcaggtctccagcacccatacagacttggtttccctcacctcagacaggatcttgctatgtggctcaggctgaccttgagctcttggttctcctgcctttgcctcaagacctaggaatgagattttcttttcttttccttttctttattagtggtatttttctagaatagcttttttaataatctaataaaaatgtgagttttaatgaattttttgttagaaaatatttaaaacttaggtggaaaataacttggtaattttagaagcataaatatataattgcagtatgcattttttgaaaaacgtttttagatttatatatctgagcattttgtctgaatgtatttatgtgtaccatgggcatacctggtgctactgaggtcagaagatgtcagatccctaggaactggagtttctgatggttatgagttcactgtgtgggtgttcctatctactgagccatctctgcagccccagtgtgcatcctgctaacataatgttggccactactaggtaagccttgggttcaggagctccgtctgggctggcctgggctgggctgaacagtgggactatctcaaacaggatgctgttgtgggtgtggttgcgtattctgagaatttaaatgtacttacatttgtgtgtatatgtatatgcatgtgtcccctacctgttgcaagtgttgattaaagaggggcttgtgaacattggtctatcatctggagaggcacttgtagcactgggaaaggacctttgcaattaaaaaattcttgaatgatagattgtcactaactatagttgatttagattgtcattaattacagttgatttttgtgcttcaattggtgctaatggctatttgtgctttgtggttgaaatgtccatactgaaactctgaggcacaggaaatttcagtgctccctgactgtcctgtctctaatatctgcgtatctctgcctccagagtgttgggattaaagatgtgtcacaactaccagctgttaacagcctatctcaacacaattctctcattacttttgggggggggtgggcaggtagggggacaccttagatttataattccttagagagccttcagtcacccatgaaggagacagtgcttccttagttgttgcctttagagtcagtttcccttatgctttgaagtaccacatcatatatatttatggttttgaaagatttcatgtttggtcatcacacaagggggaagaccaaactgtgagtgaatatacagcactctgaggagaggattggctgtagcagaaacagcacagtttcagaaacagcagaaacacagtaccggctgttgtactgtgtttgcagcgtgcttgttttgggagtgctgtggaccaagcatagagtactgcatgcagttgatcatggttttgctggaccccaccaggtcccgttggagtttttacagtgctggaatgccccgtagccttacatgtgctaggtgaacctactactaagccccacccccaaccccacacaccaccccactctgccccagaacccccagagcaggtttcacggtgtagttctagctatcctggactcatcctggactcacagagatccacctgcatttgcctccagagtttggattagaggtgtgtgcactatgccctgtgtttgtttagttttattttattttagtttttaaagatttatttattaaagatttatttatttattttatgtatatgagtacactgtaggtatacagatatggttgtgagccatcatgtggttgctgggaattgaactcaggaccttggaaagagcagtcagtgctctttacctgctgagccatctcaccagcgcatttataatgtttagttttaaagacaggtcttcttgtagtcaggactggccccaacgattaaacttcttgtccacgctccccagtattggcattgcaggtgtgtgccagcatctcgggtcctgtatagtattagggattaaccctaggctctgtgagaatggatactttactgtgtattaatggttcaatttttactatgaagacatgagtattgacataatttcaagtagtttgtagaaaaccaggtatggcgggaggaggagacagaggcaggcagatctgagtttgaggccagtctggtcctcaaagtgagttccaggacagtcagagctcctcagagaaaccaaaagaaagaaagaaagaaaaagcccacagtggtttggttaattatacagttgtattttccagtgctgggaaagagtgtgcagggcctgtgcacactaaagagaatctctgcctgtcttcaagagtttaggatccttgagccagaattgtctgccaggtggacgtggaggccaggttacggttgggcaggtggtcttcttcagaagccatctgccctgttttgagacaaggtctctcgctaggactgggtgctcactgctgaggctagacagcaaacatgggtgaatgcctggctctgcctccccaggtcaggcattatgaacacacaaccatgtgccatctttggcttctgtggatgctggggattgaggctggctcttggatctatattcttgatgattaaaccttctcccaagccctcgagtcaggttctctgtgtatatccctgtgtgtgcaaatatcatatgttggttgaaattgctcttttttgtttgtttgtttttgttttcccaaggcaaagtttttctgtgtagctctggcttttctagaacgccctcagtaggccagtctcagagatctacctgcccctttctcctgagtgctgggattaccatgtttttgagagtgaagtgttgctgtgggaatattgcttatgtatagaagtttgacctactaatttggcatgtttcattaatcagataaattaaggtaatcagtgctgcattaaaaggaatggtctttaccttacggctttttagtctcctggagtgagaggagatctaatcagtgcttgcgagttttagttacttaggaacattcccaagacattagtcttcacttccttatattctgttttttgtttgtttgtttgtttgtttgttttgttttgttttgttttgttttttttaaagatttatttatttattataggtaagtacactgtagctgtcttcagacactccagaagagggcatcagatcttgttacagatggttgtgagccaccatgtggttgctgggatttgaactctggaccttcagaagagcagtcgggtgctcttacccactgagccatctcaccagcccttgttttgtttttcgagacagggtttgatagccctggctgtcctggaactcactttatagaccaggctggcctcgaactcagaaatctgcctgcctctgcttcccaagtgcttccacgcccagctgtttcgttatattctgatttacaaataatcagcttgtgaaatgatgagtattggctgctattccagaagacctggtcgtgattcctaactcctaaatggtggctcataactgcaaccccagtttcaggagacacagcaccctcttctagcctccttgaacactgtactcatatgatgcacagacataagcaagcaacaacccccacccccactccccagcacaaacataatacaccttgcttgagggtctgagcatgtgaaatagatgaggactgagccctaggcttctagtcctgaggaatggtgtggctctgagtcctgaaggacacacttactttctttgactcagtgcctttttttttttttttgtctcagttaaccattatcttgtaaagtttttgctgatacactaactaatatggtagaccttgatcagagatggactgataggtggtagtttgccatccaagcttgaaggaagtcaagttccccctggagcttctgctttcatcatttttctttaacaccactgtcagaatcttgaggttgttagctaggcatgatgggctcactgttattccagaattcaggaaggacactgaggcaggagactgccttgagttcaaggccagtgagatccatatctcaaacaaacaaatccaaccaaaccaaaacaaagaacctcagaaacaacaatagacagggctggagcaatagctctgtgcttaagagcactggctgctcttctggaggactagggttcagttctctttaccttactcacatgaaggcttgactctgcctataatttcacttccaggagaactgacaccctcaagggccaaccatgcacaggtaaacatatcagcaaaacatgcatgtgcatgtacacacacacacacacacacacacacaccctgagatagtttgaatatgcttggaccaggaagtagcaccatttggaggtgtggcctttttggaggaggtatgtcactgtgggtgtgggctttaagaccctcaacttagctgcctagaagccagtcttttcctaacatccttcagctgaagatgtagagctctcagctccttccacaccatgcctgcctggatgctgccttacttcctgctatgatgataatggactgaacctctgaatctttaagccggccctaattaaatgttgtccttataagagttgccttgggggctggtgagatggctcagcggttaagagtgctgactgctcttccaaaggtcctgagttcaaatcccagcaaccacatggtggctcacaaccatccataacgaaatctgatgcccttttctggtgtgtctgaagacagctacactgtacttacatataatatatgtaatacatatatatatatatatatatatatatatatatatatataaataaaaaagagttgccttggtcatggtgtgtgttcacagcagtgaaaccctaattaagcccccccccttaatttaaaaaataaaaaagcaaaaaactccagcaacagcactgggaaatgtgtttgagtggtatgcatgagatcttaggctcaggcacagtcatggagcaataaaggtgaagctggcagtattttaaaggctggttagatggctcaaaggtaaaaaaaaacatttgctgccaacccagaattcaatccctggaacacacatgcctgaggagagaaccaactctacaggttgtcctctaacgtctacatgcatgcacgcactctcccaacataagcaatacatgtaaaataaaaacaatttaaattcttgtttaaaagaagaaaaatcagctgagcatggtggttctcatttttagtccttgggaggcagaaacagaggcaggcagatctttctaagttcaaggccagcttggtccacatagtgagtttgaggatagctaaggttacatagtggagactctaaaaaaagtttttagttttaaattctgtgtattagtatatgggctgatggaaggtattggattcccctagacctggagttaaaggtggttgtgagccatccagtgtgtacaggtctctgtaacttttactcttaactgtcaagccattgtctctagtcctctcaggttagggcctgttgtaacgtgggcatgatttttatctacttgctccttggtaagaaaacagatgcatctgaggatgtggtcgagtagggacagagcccagttctttaaccctagctcatcacggctgtccttcacattgtacagtggtgatgagcactgtgggggcagctctttattaacattaaggatgtagtcacagataaagcagagggtaaagcatggtggcagacactgtgaccctaattttgcagaggctgtggcatatcagactacctactgagttctaggtcagattgttataaataacaagatcctgtttcaaaacaacaaccaccacctaaaacaaagccattgcaggcagtgtaagctacagattattgtatgattcaggtttcttttttttctttttcttcttttctttttgtgtctggcttttgcaggggaaaaaaatattttttgagacacgatctcactatgtagatcagacaggagtcaccactccctacgagctaaccctttaaagcaggtagcgtcagtccggcttttgaaccctgatacatactttattttgtcagtgagttgttttaaaatgtattgcatgtatgttcgcgtgtgtgcacgcataccttgatgtacaaggggagctcagggggagcttgtggaagcctgttctctcctcctaccatgtggttcctgaggtgcaaattcaggttgccaggttggtggccgtgcctttacctgctgagccttttctggcttgagttcagcaggtttgagaagtcactgttccagcactagggattcagaggccggtggatctgagttccaggacagccagggctacacacagaaaatccctgttttttcatacacatcttttttggtttttgagacagattttctctgtatagccctggctgtcctggaactcactctgtagaccaggcgtgcgccaccaccacctggctttcatacacatctttttttagaacttttttgtatacgttttgtttttctttctgtgtatgggtgttttgccttcattagtgtttgcaccacatgcatgcagtgcccatagggtccagaagatggtgttggataacctgaaactggagttcctgatggttgtggggcactatgtgagtgttgggtattgaacccaagtcttttagtagatcagccagtgttcttaaacactaaactgtcttcctcagcatctgattttaaaaataacttttataggggctggaaagatggcttagtggttaagagcattggctgctcttcccaagttcaattcccagcaaccacatggtggcttacaaccatctataatgtgatgtgatgccttcttctgatgtgcatgtgtacatgcagataaagcactcatacatagaataaatatatctttaaaaaatgattttaatgtgcatgggattttggtctgcatatctatgtctgtattgtttgtatgcttggagcccaagagaccaaaaccagggcatccaatgccctggagctagagttaaagacagttgttagctgccatcatgtactttgatttgaacaggggtcctcaggtagagccgctagtgctcttaactaaggcatctctccagccccatattcatctatctttacagatatatgggaggcttagaaatatccctatgttgtgggccaatatggtttatggactgagtaaaagtatcgtcgctagagtctgtctcgctcacacataggtagaacaggtcatgagattctttttcatgaatgtgtagaccagggtggctttgaaataacctctgaagaggaagctggtcctgaactcctgatcctcctgcctcacttgcccaggtggtgagaggacaggtgattgtcattcatcgttgctgaaaagatcagctcttaatggaaagttagctttttaaaaactaaaatgttataggtttgtttttatttttaaaggattttatacctttagtttaatttatgtgtattagtgtttggctgcatgtgtgtatgtttgtgtacagcgtccacagaggccagaggaggatgttggacccattggaactgaaggtagagcctgttaatagccctgaggttggtcctggaaaggcactgtggtcttttcttagtagggctctgctgcaaacagattggaagcacttgctttttctgtgtgcagcccggatgttcagccatagatggttttgtagcttctctgctgtattcagcagactagctgcaagtgtgagtttcagggatgcttgtcttcactcccaggtctccttaagaggagtttagggaccacaaaagctaagtcaggctcttaggtgagttctggggattcaaattcagatccgcatgtgtacatggcaagtattgttactcactgagccaaccttctagccctagagcactttgctgtgtgtactgtctgcatgtgcttgtgtgcctctgtatccgtgtaagtcagaagtagatgttggatgaggttttgtcccaacccctgttctttcttcttttagttttttgagatagattctctatgtcctagaacctatttagattaggctggccttgaactcagagatcttcctgcctctgccttctgaatgctgggattaaagacctgtggtttcctcagtcatgtcctatcttatttttggaacagggttgttactgaacctggagttcactgactggctagagtgggtggcctggggattttcctgtctgcatccctagcacggagatgacagttgtgcaggattttgtgggtcctagggttcaagctcaggtcctcctgcttgctctgtaagtgcttcaccaactgtgcctgcccctgccctattttttcctattttgcacctactttaagagagctggacgtggtggtacacgcctttaatcccagcactcgggaggcagaggcaggtggatttctgagttcgaggccagcctggtctacaaagtgagttccaggacagccagagctacacagagaaaccctgtctcgaaaaaccaaaaaaaaacaaaaaacgtgtgctgcttgtcttggaatgggacttgtgtctcttgctctgttctttccagtgtgtctggtctgcattttttttgttttgttcccccccccccccatcttcccattgtcccctccaaaggtcttcttacatgctaacctcagctgtcactgcctgtttcccagtccctagtgattagtggccttctgtttgtattgtatcctttgttttgatgacctccctgtgtgttggatctctatggcttctctcttgcttgtctctcatgctgccactttactgctttgtgcctttgtgtggtctcagccagcccggatagcaggtcagcagatggacacagtagtacacaaagttggattgtaacagcgatgtgtttcttcattcatgtgttggctgcagctgctgtcctgtagagctggaggtcagtcctaataacagacagcaggccttgcatatacacctcatctggcctttgacagggaagcttgacaacccttagcctaaatcattcttccttctgcattggagctatttagagctgatgtgttaaagagttacatgctgttctggtttggcgcaataaccgaacatgctttatgtctaatctcatattcagcgctgatgcttggctctagtattacatgtatcatctaattcagcttcttatttatgaccactccaattggaggcagcccaaagaatcacttgtgctttctagatgccacattcagtaagaagtaatgagcaagtggtttattgggagtgacctggagcaactacaactacctaccacttactcctcctctgcaaatttgattctcttttttctggctttgtggaaggaacaactaagcccccgtctccttgtgtttccccacagcattcctacccctcccgatctttcatttggcttttacttattttaagtgtgtgtagtgtgtgtctctgtcgtgtgtatgtgttactgtgtagagagaagaggacaacacctgtgggctctgggtgttggactttagcttgttagccgtaggccatcattttgtgcttttataccacttatttctggactccacactcttcctgctactgactccttcaattctgcctgaaaattattcaagtcccctttccctgaaacaagtcccttccccgttcctcatacatacagccctacttgaggctgtgtggagcttctatttcacaggtcctttggggctctttcagattcttatgccacatttgaggctttaccagtacctgcatctctttcataaacacatcatctctcttctgactcactcctggcttgtttcccctcctttacactgctctcttacatgcttgtgctcgcctggcctcgtggcttgtgtcagcccctccccagtgcccatgcaactactcttaggccaggttgtaggagggtgatggttttctcattataatctgaggtcttaaatctgagtaatgtctttattttttattttatttttcttagacaagaccttactctgtagcccaggctgtccttgaatttgctgtgaactctttgcagttctcttgtctgagcttcctcagtagtaggtttacaggcgtggaccacgatggcttttaatcttttaaaaagtctcattatctaccacagtgtcttgcttggcacgtagtacatgggctcataatgtctttgaattcatgatatttaatagcctaaaactttttttttgggggggggggttggtttttcgagacagggtttctctatatagccatggctgtcctggaactcactctgtagaccaggctggcctcgaactcagaaatccgcctgcctctgcctcccaagtgctgggattaaaggcgtgcgccaccacagcccggctatcctaaagcatttttaaaaaacatttattcatttattttatgtatgagtatactgtcactgtcttcagacacactacaagagggtatcagtttccattacaaatggttgtgagccaacatgtggttgctgggaattgaactcaggtggctcttaacccctgagccacctctccagcccatcctaaagcatttttaaagaactacaattctatatgaagtctaggaaattagggctggagagatgattcagtgacctttagtgcatgctggaccaccacaaagaccctggatctctacactgttataacaagccaggtgtggtccagctctgtagggtgagacaggaggattgctggagcttgctggcttccagcctagtggagaaaatgccaagtccaagatgtaggggagggactctgcgtcagaggaggaggctgcatgacaggatgagtgacactgcactgcctgctttccagtccagatcgtgcacctccttacacgtgctcacacacgtgtacccctaaagtaaatgaaactagccaaagatggctacagatgtcttgctgtgttcctgtccctctgcttatggctctggacagctcggcgagatgtagagattcttaggagttcttttgagaacttctgtgaagcttcctcactctagggaactacagacaaacttgtgcgtttaaataccacttgagacaaatacagacgcttgtggaaatagacacacaaatggaaaacatttgctaaagttactttcagacattcagaaaatacagaacttatcttctgtattttttatacatatgcccacatgttgtttgacagccttctggggtgatataacacatcaacagaccatgacaatgactgtcgcagcactgtgaagttcatgaactaatgagttttattgagattcctagaggtgagaagttacttaaaaggattaggggtaactcagaaaagcagctctacactaacatgcgtaataacatgaatataataacatgtgaatactgcagccttggagccttctgtgtagtttgcaggcaggtttgcttggctgtctctgtccttagcagctttttacttctttttatactgttagtagggcccccaggaatctcacaagtcctcatccctgtttctccccccatgtataaccatccgtagtaaatgttctatctccaaagagacaccatgaccacggcagctcttataaaagaaagtgaacatttaattggagtttgcttatagcttcagaagtttagtcgattatcatcatggtggggaacatggcaacactcaggcagacctggtgccaaagaagtagccaagagttctgctttaggatccagtagcagcaggtgagggctgacactaggcctggcttgggcccatccccacatgaccttctgttcactggtctgtgagaaccccctttcctctggaggggatgttggcaggtgtagaaaacctgctgtataacagcaggtcagagcattaaaaacgagaaaggagttttgctgggcctggtagtgcctacccagaaggcacagaaggcgaggcaggaggattaagactgctatttagtgctagtaaaagtaaggtgccctgattgatttcttacgtattttacttttaaaaagttacatttgtctattatatatgtgggccttggtgctgtggtatctgtatagatgtcagagacagcctatgggaaccaattctctattgtgttagtgccctgcagcaataaaagtttcattgtgtggtggtcggtagctttacactgagccattttaccgggctgtgtgtctgtgtggtcccccaccccatgggctctcctgtattcccgctgctggctctgtagccaaggatgatcctgactccagtccatggacgtgcgggagtccagccgagggctggctgtatggcagacaggactttgctagctcagcactaactgctttcctttccctgactgggtcagtgcccagcttgcaaaaatcaatgctaaataaatacaaacattattaaagtagatttgatcatttgaagattttgtaatgctttttgtggtcggttcttagtatgctgatgtgatgctaaaggctctgcacttccatgtattaacaaagagaagacatgttttctttcatagcaacagggaggacatgccttcccagacatgaaagtgctgtagagttcagtgtttgtagtgacagagaatagaaaaccccagacagactcatgtctaagtgtgcatgtgcgcagtaaaggtaaggcttccattgagagaagcatgccattggccagcagcattggatagcatttaggagaggttggctttctgtttcccacgagttcagcactgtatagtgtaaaacagcagtgagctgcaaacgtgtgctgctacatccctggcatttgagttatctgagagagaagagccttatgggcatgtgcttggttggttgacatgttgggaagagagacctttagtgaagaggatctttcatcactttggcccttggacaactctataggactttttggttttttaattttttattgctgattggaggaggatcaatccctctctgtggaggtatgagctctggacaggaggctgggctatctatgtaagagtggcagactgtaaggctggaagcaaaacagccagcagcattccaccaaggtgtctgcttcaagctccttctttgtattcctacctcaactttcctatgatctatgggaggaaccaagacagtttgaagtagcaaattgtattttttaaagaaacagcatgttggtgtttgctcttttatattgattgttttcagacactgtataaaatggttcctacatcaagtcctaaaaggaataatatgggagaagataagatgtctcagttgatgaaggcgtacagtaccaagcctggtgacctgagttctgtccctgagacctacatggtagagagagaggtgtgctccagggcacatatgttcacctgctctcactgctgcccgatacatgcataagcttaaagcttattttattttattgcggataaaatgatttggttggtgccagttgttttgctttgcttcttctggccctaagcttataggatcttctgttctttaacccagtcaggtggcagctgcagaaggccctccgtttccttagagcacagtgcctgaggtgcttcctcaagctgcctaccctgtgctcggagtgcagtgctgctgctgtcgagctatgcctttttaaaaacatgttttttatttttagatttattgtgtataagtttgtgctactgtatgaggccagtgtggactctcctggagctagagttagaggaggttgtgaaactgtcagatgtggccgtgggaaccgagctcatgccctgtgaaagtgtatcaggtattctccactactgaaccgtgtccccagctcttggccctgaactttggaagctaatatcccacaccaaggtctgtgtctccaccaatccttctggtcgcctctttcctagactgcttatctcttcattgtgtgatcacaataaaagaataagtgttgttctggccaatattatcatattgtaatcaaaggatcaaggcatttttctcctggttgtgaatggatcttggcaagagaaggatccactatttctcctcatggggtttggttagtttcctgttgccatgatgaacctgatagaaatggcttacagggggattatttagcctgagtcgtggcttcagagcctgtagaatatggttctctggctctgtgaactgtgaagagcagtaggttgtatggtggttgagggtttcacctcaaggaggcagaaggaaagcaaaaggcgccaaccagggcaacatgtaggtcaaggacagaagccccatgacctgctaccgctaattaagcaccacctccaggtaactccaccatactgtaaataacatcagggctaactggttaacttctagccctcaggagagaactctctggaaatggacttgcagacctaacagagatacttactaaccacaatggtatttcttagtttagtcagttcattatggagacaaaccacggtgctgtcagaagctatcccatttgagtctgtacacctataatcctgtctatttctgcatgccaaaaatgtcatttccccagtgttgtttgtgtttgctacaaaatttgctttcatgtgttgtttatcattttaagaaattagtcatttgaagcttgttgttttgaagtttttgttttgggaacaggtctgtgctgtgtagattagggtgacctagggctgcagttccttccctgtcatctgcccggtgctgggacatgctcactgccatccatgccctgcaattagtcattcttgcttcctccccctcccctcccctcccctcccctccccttccctcctctcttctcttcttgaaattagatattgtgttatgtatgtaagtatactatagctgtcttcagacacaccagaagagggcatcagatcccatcacagatggttgtgagccaccatatagttgctgggaattgacctcagaacctctagaggagcagtcagtgctcttaaccatctcagtgcactgagctatctctccagcccctcttgtttgagttttgattctccagacagcgtttctgtggcttttctgaattcactctgtacaccatgctggccttgaacttgaccagctttttaaattaacttttttttactttagcaaaaattataccccccccccccccaaaagtcccatccacttgtttttctttatttccttacctatgaaagtttagcctatgaaggtttttattcctgatcttttgtggtttgtatgcttacagttttatttatgtgagacaaggtctagccctgactggcctggaacatgatgctgtgtaggccaggctgcactcaaactcacagaggtctctctgtctctgcctctctgcctcccaagtgctggaattaaaggtatgtgtcatcatacctaggtattttaccttatcttattggatttgattttgagatagggtctgtgtgcagtcccagctgtcctggaactcactaagtagattagactgagctgtttttatatatgcatatatggtttatttgtgtctgctacatgtgtagatttccagaggccagaagagagcattggctcccctggagctgaagttacaagaggttgtgggtttctttgcgggtactgggatctgaacttggtcttttggaagagaaacactcttaccagctgagcctcactctcaaaccccagaactgattgagcttgtggcagattttaatttgactgttgatgtggatatgtcttgtcaagcatcctctgctatagaaactgtcctcctagggaagtgacttagtgcctttcctgacagtgaggctaccagatgtcaagatgtgtggcagctgcggaggagaccgagtggttaagagcacctgctcaatcttgcagaaaacccagatctgttcccagtattcaaaaggagttcatacctctctaactccagttcaggggagctgatgtcctcttctgggctctgcaggtgctgcaggcatatatgagggcaaaacactcaaacatataaaattaaatctttaaaaaatgatatatgaatttctgattatattttgttgcgccttgtgcctgattctgttcagagctgtggtgtcttgttactgtgccagtgtagtaagttgaaatttttatggatttattttacatgaatgagtttgcctgggtgtgcagaccttgtgttcttgaggtcagaagagggcattgatatctggaactggttatagatgacagtctctttgtgggtgctgggattgaacccaggcctctgaaagagaaacaagcactactcctcagaatagatactctcaagctttttgagatagggtctcactgtgtagctctggctggccttgaattcaaatcgttcctccactaccaccaccataccatgaaggcagtggctcccacacctggcaaggacttcatattatgctcttctttagggatagacttccagaatgacttctagtcaacattccttcccgtgactcttcaaccttgatggccttcttgagcttatctcatctgccctgtttatccttgggtttgctttctacaaaagcccatgcaccgcagagggtgctagacgcgctttcagaacccagaaccagatcacacctttgctcttcagtcctgagctttttgctcacccaagttgctcttcagctggatactttactattagtttgctgggctgcacttgatgcagttgacatggtttctgtgggctgaggagaatgagggtttcttggagccccaggcagctttttctcatgactcctggggcacttgaggagatggttggagaagccgtggtctgctgggggcgtagcaagctttcctaggctgtaacagtgtccctctctagtccttattgcataatcattcctcaagatgagttcctaatcctgggaaccaagccaatagcagtcatctattatttttttataggcatatcgatacagacaaagattacatttttgtttaacattcagttctgggaaacaaaagatatctaaaaatgatatttttcagtagcatgatatttaagcatatttttgtggttgcagatcatttctagtcattttgatttttagaaggactgatttaatgttttgatctctttgtttttgcttgcaggcctctatatacagcatgtgcatggctagtacccatagaggccagcagagggggttagatcccctaactggagttaacataagattgtgagctgccccatgagtgatgggactcaaacccacatcctctgcaagaacagtgcatgctcctaactgctgagccatctctccttccccataatacactttagacaataaaaactctaaagcgttagatttgacaagtaataggctcagtacatgtaattctttctttactgagaagcattctagcataagtaaagtgtgcctagcgatttgagctctttgacttttcctttgtgtgtgtatatatatatatatatatatatatatatatatatatatatatatatatgtgtgtgtgtgtgtgtgtgtgtgtgtgtatatatgttgtgggggtggcctttaaactacaaccgtgcattcagtgcatccactgtgaaggaatgcatgaaagtagcctagctgcttctttgtttggagtcctaggattacaagatcccctcaagatcattcatatgcaaccccttctagagcatgctggggaaatgaccctttggcagccaccaacgggtgggttagacatcccctgtaggtgtcagtgttctggaggcagttagatgtgattctctgaaagtgtagcatcctgttatattatggttggaagtttgttgtcttgactttctgtttatacttggtatttgggggtggctcttcgtttctgctatttgctgtggtgcctgtcctgctccacagaaagttttgacacattggtgtccacagtatttgttagggtgatgtctctatctgctagtgagtccaggtagccattcagtttcctttagtgcaaagatctttaaagatgagctgggactcagtgttgttcccagagaggcctggcttcctgtcccacctggcctcagtgagagagtcagagatagcctggggctagcttggttttattttgataccttagttctttctgtttctctgctttaaagtcttcagttgaagaaacaactctggtctctgatgggactccccagcgccttgcattttgtggttatggttgatgatgatctctacagtgtgtaaaacaaactgtttcctgacatttaatcaggcaaatagtaaatgtgttatgttcagtgggcttagtcattcagaatggatggtatttgctattggcctttttcccccagacaaaacaggtgctgttatgcagaacagagctgtgtgtttctggcatgcagtgtgttgtgcttagggacttgatgcatttgatgcaagttttcagtgacatgtgtggcagagatcgggttttccatataacctgtttgttttgtttccagcagagcagtatctcactaggcacattacccttcaacattttgtgtagcagcttacacaggaccacagccatcatgttcctcacgacactgctcttctcttctcctgccctcctgtgtttcttttcttggttgtttttgttttatttttaagatgtatttgattcttttatgtaatgaattaattaatcggttaatttaatgtatgcgagtatactgtacctgtcttcagacacaccagaagagggcatcagatcccattacaggtggttgtgagccaccatgtggttgctgggaattgaactcaggacttttggaagagcaagtcagtgctcttaaccactaagccatctctccagccccaaagttaacccattaaacctcacccacccaaggaccaggtaacttcctagaattctggggattgtacagatggaaaagtatggtggccatatgggtgtgtcctttaaaattcctacaacatatgtctcagggccactcaactgggaattataaggagagatcctgaccaaagtcattcctggtcagtatttgaatacatttggctcaaaagtgtggaactggtttcctattttgaatctcaaaattaacatttggaggcctcagtgagataggcctttccatcccaaattctggagctaggatttcactctggctcccccacccccatgttcatgctgggaaaaatgaaatagcattttttatggtaattcatagaagccaagggagacatcccacaacagtttctgtggccttggctgttctagaattagcttcgtagaccaggttagcatcaaactcagattttgcctgcctttgcctccatctcctgagtgctcgggttaacatcatgtcccaccactgcctggctttattttaaattatatatatgtgtggtatgtgcacgtgctcatgagtgcccacgtagaccataagttacattaacagatggttgtaggccatccaacattggtgttgggaattgggtttgggttatctggaagagcagtatgtgctgctgttaaaatgcttgaggcatctctagtcccttgaagatttgcttgtttgggggacaagatcttacttatcatgggctaactcggaagtttttatgtagctgagcatgtcttttaacttccgtttctcctgtcctcaccggatacatactggggatggcagacattgtgctgttatgcccagtgtacttcagtattgtgtaacagaaaagagagatcatttgtatgccattacatttgcctgtgtagtgtgtatacttgtgatgcgggggcttgaaaatagagccgtgtgcatgacagccatgcattctgcccctcagccatccccgattcctgtctgttctgtttaatctggtcctccttcagcttctgccctttgctgtttttaattaaccaggcatggtggcacaggcacactgaggcaggagaattgccatatgttacagcttagtctaggtctgctgagtttgaggtcattctaggctgtttcagaatgagctccaatctcaagaacaaactcagctggatggtagtagcacataccataaataccaacacttagtaggcaagaggcagtcggatctctgggttcaaggccagcctggtcctcagatcaagttactagctacacagagaaaccctatgtctagagagaggaaaaacacccaaaacacactcctgattctatgtgagcactcagttaccgtgtgtgaattccctttctttatgtatgtagtcggggaaatgaagcaggctgaataaaaatgccctcttagcagcctacagtgtagacagcaagaggagcctgatctgggaattcttttggcccactcactcctccatagctatctcctgaataggctgctatcttgtcttgctcaggatcagaacacaaaacagtaggtaaaagtttgtgggttggtttttgtaggtttttttttttgttttgttttgttttgttttttttttttttttggtcgcttctcccctccctgcccccaaccctcacagtggtatctttgtgtggcgtgaaatactaaaaaatgcaacccatgatattccagctggtcccagccggccttgttctcatctttggcaaactctctgacgtggagctctgaaatcttgccacaggactcgctaagttcccactgggtcactaccacgccagccccgctcttccaaattcccatggccttttggggtgcacttcttgcaaacccatgctttgcagccctacctttctttctggaacccagttgagttgccatgtgaaggaaaagaccacacaaacttagttcaggatcaacagttaattcagttgctgggcacaacaactagaatcctaatcttgtaagccatattaaatataaatcaccatctaaatgggggccacttgtagctacatcttgtcctcccactgtccctgtccaaaagccctcttgcggaagctgaattaacatcaaaatacaaacagcatcagggctatccacaacacttttgagaggagcttttggttcatcccacacctgctgacatttttatacacctcccccataaacaagaaaaggtccatttaggccagctgtggtagacatctatattccctaagtctgaagatggataatcatagagttataggctgttgtaccagactatttatttgacagagttctgtctccaaaaaaggattataatttgtgtggttgtgagacagtcttctatgcttttaactttcatgataatgtcttcctttcctatgttcctttttctgtctgtgtctgtctgccctccttctccctctctctctcccttcctctttctttttaaggtaggatcttattgtatgtattgtacaatagtgaacctcctacccaagcctcccagtttgggggctcagctcccagctttgagttctaacttcctgaattagaatgttagtttttttatactgagtttgtgtttaaattcctgcttttgcaacactggtgattaacatgttaacaggattttgtttttgaacattgttgcagcttttgtgtagagatgagtctgaatgactctaagtgccctgtaatctacttctgtggttttggttccttgtagttgaagagatcccaggatcctaacaaatacttgtttgccattattatcggaatcactcctctttctgaaggtatacacaagtaaattcaattgattgttcaatcagactcactctctttttttttttttttaagaataaatttatttcatgaatacgagtacactatagctgtcttcagacacaccagaagaggccatcagatcccaaccccagtaaaccttttaaaattgatttaccggctggagaggtggctcagtagttaagagcactgactgctcttccagaggtcctgagttcaattcccagcaaccacgtggtggctcccaaccatctgtaatgggatctgacaccctcttctggggtgtctgaagacagctacagtgtacttatatacatgaaataagttttaaaaaagttttgctcaggtgtatcttgatctgagtgcaggtgtctgcaggaatcagaagaggaggtcagatctcctggacttgacgagtctcccagtataggtgctgagagccaaagctggatcctgcaagagcagggccgtctctccagctccacaacttaatttttaccaatagttgatagagttgtcagatgatgtaggatagggcttgagtcaagctagcaggaaataatgaggctgactagttagggctgtttgtagcttccagttgctggggggttgggagatgagcaacatcttatgctctgcaaaaagctttatcctgagcgcagttccattctactgttgctcagagggctccctgtgtgcactctttgtccttatcattgatagtagcaggagacatctgctggtgaggcctcgtatgtatggtgcacattcatgtctatttgcccctaatttgggaagacaggtggttagggctacctagccgtgcagatgtgtgaccatgagcattcctgatgctgttcaactctttaactcccagctgtagagcagtaaggtcagctgagcatgtaagtgccaaacattttcataagctagactcctcaagggatattacaaggagtgggattgggtgcatgtcagtgagcctgggctgctagaagtacccatgaggctgccggagacagcagcactgcagaatctgaacagcttcttgtttggttttctgagacagggtttctgtatgtagctctggctgtcctagaacttgctctattgaccaggttagccttgaactcagagatctgcctgcctctgcctcctgagtgctgggactaaaattgtgagacaccactgtcctgcttgaatctgaacttcttaaggtgatattgaggaactgttttggaaagggacagatcacttaggaatggtcttacttattaatatctgtattgtcaggaggtacatttggatactgcacagagacctaagcttagaaagttaaaaccattctgcctagtcacacatggtgggcacttgctagctatcccagaactgagaaggtacatgcaggaaggagtgctacaagttcaaggctagtctgggctacatatttcaggctatctagggctatatatagtaagactgcctcaacacaaaaacaagacaactaatgtatttggctatagatacttagtgtcgcctgcctgttgttcttcacagatgcttttactgactctgctctcagcgcaaaggtgaatggtgagcacaaggagaaggacctggagccctgggatgcaggggagctcacggccagcgaggagctggagctggagaatgatgtggtgagtgccctctgcaccccagcactcagtgtgaacgtggggagaactccacacgtgcagagcagcactttctctgggcagttgctaaagagggagagaaggaaagaatttctccctgactggagtcggagcactcttaaattacttctttgtgatgatcagttacttcagggaactgatagttacaagatggcagcctgtttcgttttgaataccaaccgaaagcaggtagtgtttaattgtatgttgacttccttagaaatgaggtcaaggtggataaagagttatcattaagatagtttcaggttgggtgtgacaactgtgatgtcagcactcagtcgtagaagaataagggtttaagagttcaagatcagcctccactaaagagaaagtttgaggctagcctgagctttataaagaccctgactcaaaacaaaacaccaaaacaccaacaacaacaacaaaaaacccaagtcagctaggtgttacctgccttaataccaggaggcagagacagacaggtctacatagcaagtttaaggctagctacggctacacagccagatagtggatgaaaaatagcaatcataaaagataaatacttaggttacattaaaattaaagcctggcctaaatttcttgaacttaaaattagtatcattctctataggaacttgcttctaaaatgaccatttgtcatacattattttttgttttctcttggcaccccatctacaagtcaaatattagtaaactttgatggagcatagagcttattatattttctttaattaaaaattttattttatgcatatgggcatattgtatgtatgcctgtgacctattcctaatgccttgagaggccagaggagtgcgtcagacccctagagctggagttacagacaactgtgagtttccatgtgggctaggacttgtactgggtcctttggaaaagcagccagtgcttataaccgttgagccctctcctcagtccccttgaacatagagatttaatgttatggagcgtcatgaataagactgagtgagcaaagaaccttctgttgtgcacagacaaccaagtttactatttaagacatagtaagggaggaaatagtatctcttctctaagagctcagccccctcaaagaatagaactgccctgggaagttgtcagtgttaatcttcaaagtttatttatttatttttttgttttgttttttttgtttgtttgtttgttttgagacacagggtttctctgtgtagtccaggctgtcctggaactcactttgtagaccaggctggcctcgaactcagaaattcgcctgcctcagcctcccaagtgctaggattaaaggtgtgcgccaccatgcccggcttaatcttcaaagtttaaagaatctcctaaacttaatataatggttttcatgtgtgcatcactgcaccattgtgatgggaaacaggtacagtttttactttattagtggagagataagttctttaatggtttgagggggagactcaggcagtttatcagtatttaaaatgtaagtgtggtttgttcccaattagtcttactacaaagaatttaccttagctaggcagttgggttctgagttcaaggacaacctgatctacatagcaagttctaggccttcctagggtatcctgtgaaaccctgttgtttgttttttgtttttgtttttaagacttatttatatcatttattttatgtatgtgagtacactgtaactgtcttcagacataccagaagagggcatcagatggttgtgagccaccatgtggttgctgggaattgaattcagggcctctggaagagcagtcaatgctcttaaccactgagccatctctccaacaccccgtttttggtttttcgagacctgtagtagccctggctgtcctggaactcactctgtagaccaggctggcctcaaactcagaaatccgcctgcctctgcctcccaagtgctgggattaaaggtattggttaccacctcctggcttgagacccctttttaaggggaaatatataaatttaaaatagaaaagaatttatcttagtcctaatatacctataatacgtgtaaaataattatatgtcatgatattttttcaacattatttctattagtagtttcccatcagaaaagcacaatgctgatacttaatagacatttgtgtacctaccaataaccagtattcaaataggaaagatacctcatatatttattaacaggaaaagcaagctgcagagtagcaataaaagtacatagtgtgtgtgagagagagagagagtgtgtgaatattcagtttatgtgcaccataaaatgttgcccagagctggcctcggttacggggagttgagatctgccttgcaggtgctgctgctgtacatcctttttctaagttctaagagcatactttttgttgttgttttattggcggtggtggtttttttgtttgtgtgcttgttttgaaacagggtttttctctgtagacctggctgtcctggaacttgctctgtatacctggctatttgaactcagatcttcctgcctctacctcgtgagtactggggttaaaggcccgtgccaccatgctgagctctgtagtaacagctcttaaccttggaaccattggcctaagcccgtgaaactcctcatagtggttattcctatgccctggaacttgaaatcattagttttggtggatatttttctgttcagtgtgatggatcactcaaattactgaagttagagtcttccaattaaaaaaattatgtatctatctatgtatccattgcgagggagagtgtgtatgtatcatggcttgcatgtagattctaaggacagcttgtaggagttgctgctcttcctccaccatatcttccagaaaagtccatgtcctctagaaaagtaatatgttttcttgattactgagccctcaacctgtcagactttaaaaggagagtttgatgtgagatttgctggggaccaggagttgcctcacaaactacatgaacactgatatcagtcagtcaggaatagtttattgactgttccccccaggactgatgcatgagggctgcagatgtgacagtgagtcagattctgtagggctttcaagcctgaaatctacaaacatgtgtgccatgatcttctgccagtcaggatgtggggatagggataggcacttccttaggagcttgtctttggtgtacatttactctgcttccattggttggtgtattcagcagtggcaaggtcttgccttgcctaacactcatgtcttaacttgccaatcaggatgtcagttacccatgtccatacctttttctagcaagtaggatgtcaattcccaaggagatcttggggacttaaactttacttaacccctactcaaaatggaagccttatttttaaaaagcttcttatattggtgcaggtgtttctcttatgttggcatccatccaaggggctgcttataaaagcaaaatccatgaaagtttatacataggtgtaggaattgctgctgggttgttggtttgggtccaagctattgtggctaactatacaaagcagttctgctgacttctgttgcgattggtttccaagaacaccaaagcacagaagttaacagaatctgcaatcgactagagcatgagaaagtttccttatggcattagtaacttcacaaaatggcagactagaaagtaacagttacctaggccttaacaaaattaattggcaccgaagattctcactttattttcctcatttcttcaggttgacgagtccaacctatgttttgagagtggcagtttagtccttcacctgtggaggggaacagcactgagtttggaagttaggacaaggggacccatagctgttgctgagatcttcaaacagctttaaagcttagcatgtgtgacacccatttgcctccccatggctttgtgctgcccttcctcacctgcctagggaaggggaaggggttctggcatggaactcttggagggaaagttttgactctgcttgtagggaaggctgttaggacaggtgaaggagagacctctgacccagaggcaccggatctttgaaaactcatgtaccggatctttgaaaactcatgtaatctccacggacttaaaagataatatgtgtgagagaaaagctcttcctaaagagttgttttttgtttttgtttgatatagggctttttttttctttttctcttcctcttcctccttctttattcttccttctttcttctttcctccgcctcctcttcctcctcctcctccttctcttcttcttcttcctcctcctcatcactgtagcccaggctgacccttgaactcaaacattctcctgtctcagtcccctaagtgctggtataacaggtatgagctctatctggcttgtctttaatgttttctaaagtaaagtttggcccttttgtagggaaggagtcagagttagagtcaactagtatggtttgctatatgttcctataaacactaattgtagctaaattgaaagttgaccttcattttccttctagtctaatggatgggaccccaatgacatgtttcgatataatgaagagaattatggtgtggtgtccacatatgatagcagtttatcttcatatacgtaagttcacagagttcccttttatacattttagtgcatttgtctttgattttcatcagctcaaaattactttgctaactaattatttcttttaattttaaattaaacaacaatatcacattgtttctataaactattcagactgacagactcacattaaaacagggaataagtgttgtttccttacctatccttagttttctgatcaaaatacatttttttctgtttttaatttgtaaataaaaaatgttaaattgacagggataagggtgaaccagttcttgaaatagtaagtgttcttctttataacataaccacaaaaaatagtattttgatttatgatagaaagcccccaactttgtcagtgtctttgaccccatactatagagtctgttaatagctgaggattaaaatgatcatgcatgtcttcttgtctttgtgtttagggttcctttagaaagggacaactcagaagaatttcttaaacgggaggcaagggcaaaccagttagcagaagaaattgaatccagtgctcagtacaaagctcgtgtcgcccttgagaatgatgaccggagtgaggaagaaaaatacacagcagtccagagaaactgcagtgaccgggaggggcatggccccaacactaggtattcaacatgattcaaagtctgtgtgagaggatgtagtctgactgtttcctttttttttttttttggtgaagctaaggagaaagtgctccttgatttggcttaatattctgttggagagctgggcagtagtggtgcacgcctttaatcctaacacttgggaggctgagttcaatgccagcctcacccccccccccccacacacacaaatttctgttaaaagattacggtcattttaatagtatcatttgggattagctctctggagtcaagtgacccatgtgaggagccagcccagactctgaggagctccttaaaataaggttggaggaggcagaggcaggcggatttctgagttcaaggccagcctggtctacagagtgagttcaaggacagccagggctatacagagaaaccctgtctcgaaaaaaacaaaacaaaaaaaaaaaaagaaaaagaaaaaaacaaatccaaggttggacagtgtggcttgcatgatgaaggtcttttcagagcagtagaatatcagaatggggaagaactagcattgcctgtgtagttcaagagagcctcaccaggaggtgacaagtttggtatgataatggatcctgtctggccctgggagtgtggggggttatttcacctctgtagaacatggtcctgtaagagaatctggcctcttccggtaaagactaagatcccaggatattcttcatgctatgctggcaggtggcagaagcatttgtgtgccattcttgaagagtagtctgtagggaacagtgaggaacaaagacactgagtcagagagcctgtcagtgtgacagcattatagcagaaagtggcaagctgccagacagactcatggcgcgaaagctggaaaaactagagagaggcgaaccttacttgaaaattcagctgttcatgatgcttgctctgagaacacatgagctaaaggcagtgtggggtgacttagaaaggagaaacgatggcgcagtggttgcttgtatttgcagggctatgggtctgtcatttactcaaaaaagtagaatgcctgctgcattgtgggtaaagctgattctaccggcaaggttccatagctgagtcttccgatttccctaatcatcactgtgtcaggatgaaagtgagcacacctttttaaagtgctggtggccgagacctgcagggctgtgtggccgtgtggtgagactgaggcttgtgtgagagacagtcttctatttagtgtacctttcagtgtgttttgttagcccagtactttttaggataaatgatttagaggatctctcatttccagggacaataaatatattcctcctggacaaagaaacagagaagtcctatcctggggaagtgggagacagagctcaccacggatgggccagcctgggccaggctccatgccgtcaagagctgcttctcacacttcagatttcaacccgaacgctggctcagaccaaagagtagttaatggaggcaagtattttgaccttatttgttaatgttttgatgaaatacagaactatctaaacatttaagagttggcatacctgataggaatgtgcatgccatttgtggattttttggagtagtttttattatctataatgtagtttgttttgtggctactagacagtataacactgtatctgtcattggcgcgtatagggtgacagcatgtcctgagctgtttcatcctctcatactcatttggcctaagacactccacagacagacagaatggaaacttgaaagacactgggtgatgaggcagtgggcatagttcatgagaaagaccctgagttagtgcagattccttcattaactgtgatgattccattctgcgtacttcagggaagaacttagggtgatttgtaatgtcagaaatgagcaagagtcaggtgacgaaagtcatcagagaactgcttacaaacacagcacagacaacctttgatttctgagagtaggtattagagtgtagcagcttggagctttaagtaggaaggaaggcattttgtgtagtgtccccagtcagttgaatacagattataggtgagtatagaaatctggaagatgggacagcagaagcgaatcatttagaaatatggtagctgacagggaaaaagagtggacagcagattcagggttgaagtttagagcaccgcaagctgggtgaggcaagtgcctcatgctgagcagtcaggctccataggcagtctgagccagcctgggttgtgtgagacctcgtgtaaagaaagggagtgaagtatgtcagccatgtaagagcagaattcctctccaaggaaacactcttgagtagttctcctgcttagtaacgatggtgacatttctttgctcactgagtgaagattttcagttgtttatgaatagaattttcaagttaaaaacgtgaagggggctgagaaatgtatgatactccagtgagtggagccccctagactactggagaggaaccctggactgttgactaattaccagggacattgctgaccggggcgggggggggggggggggttgtccgtgccctgatgtcaggtttgggccccgaggcttacaggcccctgtggtgtacaggcagtagatagacggggccattcattcctgtgcatcaggatgagattcttttaagcattcgagaaagcaatagaagtaagctctcatttctacctgaacaggatgtggctagtgacctttgaaactgatatttcagttcagatataggcctgaggaagctcaggtgagagtaggagaagagcctggacagtggcgttagaggctgctgtttgtgtttattgtttgggcctgccttcccgagcaggagtcagtgtgtttattgagggggttatctgtgtgtgggacattttcttcacaagtgatggctgacaacagctgaagaagtaggcatactaggcagagtcttaactgtcttcttcagtagtatgtgtagatcctaattaaccctttgggaacgtggattcatttcaacagacttaattttaaggaggttaaagtaaaatgtgaatttgtgtcagttaagttgtactaaaacttatcacaaatcaaatgactgtcctcaaagggttaaatgtacaagaaatcatttttgtcattttacttttttttctgtttactttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgaggccctccagacccccgtctcacccctctgctcatggttctccagctcctgtctctactatgcctaaacgcatgtcttcagaaggtacaataccacgatttgttcatgtttttgtttgtctttgtttagctcctttgtgaggttatgattacaaaatagtttcctcttcattatttaataacctataatttttgtgttttaactttagtttattaaagctatttctaataaccttttgttcactagattaaaatttgataagtgctatgtataaagccctgcactgccctgcatatagagatgggctccgacctgtctggtaatagtactcctgtgcagcccaggaaggtctcggcctggacagtaacagtgatgaactgggcatttctgctcctggaggtgggtggggttatggaggctgccacattcagctccttggtaatggtgccagcgaaccttcctgttggccaaaggcaggagtactattttggggttcttagtgatccatgacatcccttgtagtggccttgtacgtctgccctcaggtaacagtagtatttagagtgcctgaggaattactaatttaattgaataattattttaaattagttttataatatcactgtagtggaaggctgctttaatctgtggggagacctttatttaaagtttatcaattacaaaacaggtatagatttgagccttttctgtctttttggctcatgccaaattgtgtgtatttgttgctgaattcaccattgttgcatgtcatatactttgattagtggcacatgcctataatcccagtgcccaggccacaggcaagaggattgctgaaagttgaggtcagtttgtctcatatataatgagttctaaggctgccaggactatatggtgagaccctatcccagccaccctgacaccctgcccgaaaaaggtagcattctgatttaatgcaggttgtaagttctaagtaacaatgtcctttgttcagagcatttgtgtttatattctaatcaccttgtcttggtaaaatcatagtgaatataactgatcaagaccattaaagttttctaaagaaggtgtttgggaataaactatattggctactgttaaatttttgcccacacagaagggaattcaaggcagaagaatacaatgttgcaaaggcagatgtcacagactttcaatgcgtgcctctctggtgactcctagcagcaacagggagctgttgcagacgtttgggtggaggtgcttattcctcgaatgtgtcagaaagcattgcattgtagtcagatgaaagggctgcttttggactgcccagaaagcgtgccatgggaaaagtgcaaaaagagaagtgactccacaaagatgacttcacacacacacacaccagcacatacaaacccagtccataccacacatatcctatagtaatgaatacattttaaacattaaataaggggaaattctaacatgagttagcatttcctcagagcacatgtctgactgtgttcccactgaggacacagcagagagcatgtgctagggtcctcatcatggcctctgagaggaggggtagttctggacttgtgtgctacaggctgtattcccagaagtccccatgggtggcagagacagtgatggtgactgtcgtcagctctcacagtgcagctttctgcagactttccttgttctgctcttacaagccaaccacgcacatgtgaggacggcttgggcaaaagatggagaggagatctgaggttgctgcttaaattcctttttcccctggggccctgaaggatgtagctcagagatagaacactagcctaacaagtatgggctcccaagtttggttcctatcaaaaaaaaaaaaaggtttttgtctcattttggaaatagtaaaatctgttagaaagataaactgataatatcccatcatgcatctgtgcttcctacgaaaacgttattataacttatttttaaatgcatgtagttaaacactgttgggccatgttgttatatttctcaccatcaagtttatttcctccttgctttaaaagtaaaaggaaataaggctggaaagatgggtcagctgtcagacagctttctgctttccagaggaactcaggtgcacaccctcacacagacacatacacacaatataattaaaagtaaaacaaattgtaaaaggggaaaataaaacatactgacataattgacataccacaaaagaattcttagtgtggccagaaatcaataacagtgtgattcatattctaaccaatgaaaacctgctaaggaaataagagttatatctgtatctagtaggaaaagcagtaaggtgggcaccgcaggactgatgtgatatcctgtggcatccttctgtcttcctcaggacccccaaggatgtctccaaaggcacagcgccaccctcggaatcacagagtctctgctgggagaggctccatgtctagtggcctagaatttgtatcccacaatcccccaagtgaagcagctgctcctccagtggcaaggaccagtcctgcagggggaacgtggtcctcagtggtcagtgggggtaggtatgacactgcagagctgaagatctgagattaaatacagattaaatgtggtggcataagcagctgttgccagttaccatggttatcaagacacgagttgaaggaactgtcccatccctctggaactctgaccctgtatacattttgtaaacctgcttaggtttcttactgctgcgggtttccatggcatccgtgtgtggagtaaacagatagtcgcttggtgctcctcaaggagtagtctgcgccaggagaggctcagcttttgttatgagtctctgaccgtcagcagctgcagccaaggtcctgcttggagcagatttggaattaggccagactgcttgggctgctgagttggtcttgttggtctgtagtgcttcctcccgggagtccagagctagagcttgtgcctgttcttttggccttaccaggaaaaggtctttaagcttaaaaaactagacagacagtgcgctcacccctgtaaggtgtgcagttgtagtgattgtcctgtaaatttctttgtgctattcttcttagccttttaaactgaagattaacaagaaaagaagcttgaggcgttttaaccctattataaataagcaaccttttataaatacaagaatagagacagttgagggatatagtgagaatcgtgttacggggttggtctttccatggaaagttagagttgtgaacagtttccttctataatgtttgattgaaccattttcattgacccctttagtctgaagcctgcaaataggtttttattggattaggaagcattaagcagttgtgtggaaggcgttcattctgtgttacgtaccccttgaggctaggtgcgtcctaatttccttcagcactggcggtggatctttatattgcaagtaaaagcacataggcttggcagcaagctaccatcaattttatttcgtgtattgatggaaggagaggagagaggcatggtagagatctctcaccttgaataaatgttacactttgaatgtcgtctttttttttaacttaagtatgctttggcttgccattgaacttgactcaaatacttaaaagttcactcatttaattaggagggaaaccacggtggtacttagagattgttgacttctgccataagatacttctgagaatttaatgagtatctttttgcttctagttccaaggttatctcccaaaactcacagacccaggtctcccaggcagagcagcattggaaactctcccagcgggcctgtgcttgcttctccccaagctggcatcatccctgcagaagccgtttccatgcctgttcccgccgcatctccgactcctgccagccctgcatccaacagagcactgaccccatctattgagggtatgcaaccaacacctttcctgttgtaatccatgcatggccaagagttgtgttctcaatacacagtgatgcttttgtggatgcaagattctgtctctggtagaactattccatgtatattaactaatgtctggcatcagaggctctggcctgtcctagtatgacgtgcctgttgtatgagcatggttattgaattttgatgtgatgactaacagggaataaactcagtttaatgaaacccattttcccctaagccagaaggttagaagtgtttggtatttactcacactattgtcctaatttctgtctaatactagttttttgcttttttaaacttgttttctagcaaaagattccaggcttcaagatcagaggcagaactctcctgcagggagtaaagaaaatgttaaagcaagtgaaacatcacctagcttttcaaaagctgacaacaaaggttagagtttgttaaagtttttttttttttaaaagatttatttgtttattatatgtaagtacactgtagctgtcttcagacactccagaagagggagtcagatctcgttacagatggttgtgagccaccatgtggttgctgggatttggactctggaccttcggatgagcagtcggtgctcttacccactgagccatctctccagcccttgttaaagtttttagacacaattatagaaatagcaaagtgtttagccagacagatacttgcattgctagtctttacgtgatagatctgtcttcatttcttatttatctcttcccctcagccccagtgctgagattaaagatgttatagaggtgcaccaacactcctggcctctgttctcatttctaacattccatatttaacaattttaagtttaaaggtaaaagtaaattggaatctaacaggttttggttttacaggtatgtcaccagttgtttctgaacacagaaaacagattgatgacttaaagaagtttaagaatgattttagggtaagttctttatcgactggttagaattaaaaaagaaatagcaaacataatgatttttatggccagttcacaaaagtacactattaaaacacacgcacacacatacgctcttgtcttaagtcatttgtacagcaagctaaacttcttttcagttgtttttcatgcatatgagtgtttgcattatgtatttgggctatgggtctgcctggtgtcctttgaaaccagcagagggcataggatttcctggatctgaagttgcagatcgtcatgagctaccatgtaggttctgggaactgagctcaggtcctctggaaaagcagccagtgctcttaaccactaatgtctttctccagcccacagggtttgagagagtgtgtgtgtatgtgtgtgtgtgtgtctctagtcttgtttgtctgtgagtaggtatgtacatagtacttcaagtgccctctgagggcagaagaaattgttatcatttggaaatggggttaaggcaatggtgaaccgcctgatgtgggtgttagaaattgaatttagattctctggaagagcaataaatactgttaaccactgagccatctcctcagccccttgacaattactcttaaagatgtctttgtctgttctaagtacaataacttaagatcacaaggtttttgtttgttttttggtgtgtgtatgtgtgtgtgtgtgtgtaacaagactgcaggtaacaaaggatatgatcttattttggaaactgacacactagagctcactgctcagtagttctaaagttgaagactgaccacgtcagtgcttgtagtgtgtgcagtagaagatgaaatgtgtcctgagttagctcaccttccaatctgtgagtaaattcattcacttgttcattcatcctttttggtgttgaggattgaagccagggctaaattcccttggtgggcgtattcctgtaacctcacttcatatcctaagacaagcttccaagccctccttggttactctgtcattcttccacacaaaatttacaaggagctttagatactacgttagcttatataacttttaaaaatgacttctttgtttttattttatgtgcattgatgttttccctgtaagtatgtaagtatgtaagtatgtatgtatgtatgtatgtatgtatgtgtgaggatgccaaatcctcagaattgttgttataagcatacgtgagcagccatgtggatgctagaaattgattctggatcctatggaagagtcaccagtgctctttaccactgaaccatctctccttccccccaaattacgtttagaccaataactttttatcctttgaattctatactgttggggttttttgttgttgttttaactatgagtttccttttgttttgttttgttttgttttgtttttttcatttttttaagatattttatttacatttcaaatattattctcattttcccctttcctagtttcccctccgaaaatcccctatccctttccccctctccctgctgctacccgacccacccactggcattcccctatacctgggcatagaacctttacaagaccaagggcctctccttccatggatgaccgactaggccatcctctgcctgttggttttcttttttttgtttgttttttgtttttttgagacagggtttctctgtatagccctggctgtcctggaactcactctgtagaccaggctggccttgaactcagaaatccgcctgcctctgcctcccgaatactgggattaaaggcgtgcgccaccatgcccggcaggttttttttttttaagatttatttattttaatgtatgtgagtacactgtatctgtcttcagacagactgaaagagggcatcagatcccattacagatggttgtgagccaccatgtggttgctgggaattgaactcaggacctctggaagtgctcttaatcactgagtcatctctctagctccctatactgttggtttttatttttattattttttggttttggttttgttttgttttttgttttccgagacagggtttctctgtatagccttggctgtcctggaactcactttgtagaccaggctggcctcgaactcagaaatccgcctgcctctgcctcctgagtgctgggattaaaggcatgcgccaccatgcctggctattttaaattatatgtatctgtgtgttagaataagcacatgaatggaggcactcccagggactggtggtgtgatatttttctagagctcgttagagctgcctagtctggtgctgggagccataatctactccgttgggagagaagagttcatgatcttaaccactgagtgagccacccatcctccccaccaagttacattgaaatacctgttcagggagtcttgaaatttagctattatttagcatttatatacctatatatacatgcttttgtatctctgtattaaatcttaaaactcacaaatgagagaaaacatgtaataattgtcttttctgaatttgcttaatctgatactctgatgttatatttattttccaattgttttttggatgactaaagctgtgaatacccatgtcacatccttctcagtcagtcctctgttaatagacacctggcttggttctgtaagtagctattgtgaatagccctgcaagtgatgttgataaggtacactatctgtgacacggctttggagtcctttgagagttaatcgctgggtaaaatggtaggtctatttttatttttttgggtttggggtttttttcatgattgactttacagattttatttatatgttcatatgtgtgtgtttgcacatgtgcaggtgctctggagctgaagttgcagacagttggtaagcctgagtccatgtgggtgctgggaattgaacctggaagagtggccagtgctcttaactactgagccatctttcctgccaagcgctttttagtccatagagactggacagctttacattcccaccagcattgttttctggtgggagcaaaaagcgttctttttactccacatcctcactaccatttgctgtttgtttctaatgactgccattgtgactgagttaggagagaaactgagtgtgtgtgtatgtgtatatatcttgtctaaaataagcgcatctctgtgtatgtgtgtgtgtttaagtattcatgaatgaggatacctggcggggtcacaggctttggatctccctagaattgtgtgattgtgtgctcagtggctggtgttgtgtgttgcatggtgcaggtgctggaaactgagcttgcatcgtcttccagaggacttcatactcataaccacttcaaactccagtttcctcaatggagtttcaactcaaatttctctcgtgcctagtgatcttgaacatttgtcatggattcattgactattgatgtgagtgttttgagaacagtcttgtgtgtttcattcgcctatgtaaatgattttgttatttgagatacatacaagtaagtacacacatgcacacacacatatgttgggagtactcagctgtcctttgttacacatcatgctctgggttattcttgcttccttacaaggatgaataatgccaacagaaacactgaggcttggtatcatgtaaacatgtgtggtcacttctttaggattggaaagtctgtgtcatgtggtagtgtgttgagtctttgcaggaactaccagtcattgtaccatggtagctgcatggtctccattgaacactccctccaccatcagctagcaagttctttttattttcattttgggtttgtttttttttttttgaaacagagacttgcattgtaactgcagctacttcgtgtcacaggcacacaccacctggccatgtgtggggacagccattcccctgaaggtgctggggttcatggtcttagttgtggtccatattggttttcatatgcagagctctcgtggccagtgatgtttattgccgtcctttgtgttcattgtttgcttgttttgttgttgtttagattgctgttttttcatatcctcaactgtaaaactttagggtgggcactggtgagctagctctgtgggttatggcagcctaagttgaactccctagactcacatggtgggtgaaggaactgacttccagaagttgccttccagcttcccataacccccttcctgtatgtgagataattaatctttgttcttttttttcttttttttaattttttttttttaaggttcctctgtgtatctctggctgtcctggaacttatctgtagaccaggctggccttaaacttgcagatactcctgcctctgcctcttgagtgctgggattaaaggcatatgtgccatcaccacagctcagctgctaagtaatctcttttaaactgggtttttaattaatgaattgcagtaggctatgttcgtgttccttctttttcttttcagacagtgtctctgtgtagcccatgctgaccccagcctttaggtctctctctctctctcactcggctggggttcttatgtactgtagatcccagtctggtgccgtttgtctaacacttctgggatattaggtttggcacccagagtgacacagagctccagccttggtcctgtatccgtcaaaggatctgggtgtgtgaattgcttttctcccatttcatgggctgtcttttcactttctgtcccttgagacacagctttatttaatgacatcaaggttttttcctggtatcagttgccccttagcttgagagtttggtgtctggtattgcaaatgactgtttaatctcctgaagatggcagcacttaacctgctttcttaggacttcctgggagctctcatctgtgtggttcaccttactgagcgaggctcgcactcagttacactggtgtctatcaggaatctccccgtcatctgtcgaaaatgggactgtattcacctccactctggctccaagttgcttgcagatagggaagtttggtattagctctccatttcttcccatgtccatgtgttgtagttgatacctttttgaaagactattctttctagacttaatatcgcatgcctttaatcccggcacttgggagacagaggcagaggcaagcagatctctgagttcaagaccagcctggtctatgtagtgagttttaggacagccagagctatgcagagaaaccctgtcttaaaccaccctagcccccaggctgctctttatttattgtttacttaatattccaaccactgatactagtttgcaactctctttgtttggccctaccttactaatgaattctttctctgtcctgatacttattattttttccagccttgatttgggcttaggttgtcgtcactcttctgatatcttcaggtacagcattgttacttattgagatcttatcaaattctttttttttataaatttaactgaatttaattattttaatttttgtttaattaattaacaattgggcattacatttcttctttaaattaaagttcaggtagcactggcatcaagagtcggtctctaggagtggatcatacttattttgttgagctcctgggcagtgagtaaatgctaggaaacaaagcaggggttccagggcagggttgacactgagtgcttcctgtgtttcagacacttttctctgcttgtgtcctagcccctcctgtcacagtgatgctctgaagcaggttctgtcactgcctgcagtgtgtgcatcaggaaactgaggcagtgaggttaaatcatctgcccagggccccatggataggaaagggcaagccttggctctctggggtactgcagtgttcagccatcctcgtgacatggaggtttggttttgaactgcccttttcttgagagcagtctgcactctgcagtatagctgagtattggaaatttgatacagaggatttctctgtctgatctgttaatgcttagtaactgagattatgcagatagagatttttctttcacagtatattgcctagtgtcccaagcacagtagggactggtagaacctacttgggttgcaggtggcagcatataactgtgggccctgcccttgctagtgtctgtggtccacgcttgttactgggcatgacttcacattgccgaggtgtggtgactggtcctgacagttgcttttctctgagttacaaaaaggcatgggtttgggtggggtttagctctgtgtgtttactgtggactagttgagtccagtcccaccaaacacacatatcccttccctacagaatttttaaaaaatatttgtttatttatcaaatgtaagtacactgtagctgtcttcagacactccagaagacaacatcagatttcgttaaggatggtcgtgatccaccatgtggttgctgggatttgaactcaggacctttagaagagcagtcagcactcttaaccgctgagccatctcatcagcccctccctacagaattttaattgcactgttttctccatgggtttgccataaaagtacctacatcaaaatttaggccattgtgtggattaaacaaataacacaaacagtttggatctataggtaattttgccattataagaatagaaatgagctgggcatggtggtgcatgcctttgatcccagacagaggcaggtggatttctgagttcgaggtcagcctgtctacaaactaagttccaggacagccagggctatacagaaaaccctgtctcaaaaaaacaaggaaggaaggaaggaaggaaggaaggaaggaaggaaggaaggaaggaaggaaggaaggaaggaaggaaagagagagagaaagaaagaaagaagtggaaaatgcttttttaaaattttattcctagcatgtttttgtatgatgtgggtgtgtgcccgtgagcttacatcttcaggcttgagcaatctcttcagctctttgcattttatgtagattcatttttatttcatgtgtccggtgttttgcctgaatgtatgtgtattagtcagggttctctagagtcacagtacttatggatagtctctatatagtaaaggaatttattgatgacttacagtctgcagcccaattcccaacaatggttcagtagtagctgtgaatggtagtctaaggatctagcagttgctcagtcccacatggcaagcaggtgaaggagcaagagcgagactcccttcttccaatgtccttatatggtctctagcagaaggtgtagcccagataaaaggtgtgtcccaccacacctttaatcccagatgaccttgaactacctgtcttaatcttctggaatccatagccactatgcctcaagatctccataacaactaagatccaggtcagaaacttctatctcccagcctccagagaagggtcactggtgagccttccaattctggattgtagttcattccaaatatagtcaagttgacaaccaggaatagccactacagtatgtatgtaagtgcactacatttatgcctgtacccagagcccaaagaggacaccagatcccttgaaactaaaattttagagattgtgaccatgcaagtgctgggaactgaacctgggtcctctgcaaaaacagaacgtgcaaatgtctactgagccatcactgcagccctaatttttaagtttaggaagttgtcgtatggtcattgtatattgtcctaggtttcataagcacattcatataaatgtcgatgatacactctgagcacattccatctcctgttctctccctttcccctttctcatgctgttgggattttaaaattagtttttgtttagattagatgttgatctcttcaggagctattccttcatggaggctgctttttctttctgcgccacatggtagcttcccaccttcctgtgtctaggcagtcggaactgttgcatcttgttcactgtcagccactgcctctgcctctccaattctgaaattgcaggcatgagccaccatcagtctaatagttaattcttttttgttatgccttgggcgacaggggcgggaggttgagacatggtctctctacatagccctgcttgctctctgggaactcactatgtaaaaactaaggtggtctctaactctcagacgtgcctctgtttcatgagtgctgaacataaaggtttgtgccaccatgttcagcctggctaataactagtcttggatactggttcctaaaattgtgttgtgtatcattctgttatttgtgcctgaaaaatgcatattctgagccaggcatggtggcctttagttccttccagcattcaggaggcggagaaaggcagatcacagtgagttcaggaccagcctggtctacatagagagttccagtacagctacactcaggttacacacagagaccctgttctgtcttaacaaacagacaagtccaccaaaaaggccatattctgaaaataatgaaaacagaaaacctattcaaagtattttcattgccatcacatactacttggcttatacttaatgggaaattatttcttatatttagttacagccaagctctacatctgaatctatggatcaactactaagcaaaaatagagaaggagaaaagtcacgagatttgattaaagataaaacggaagcaagtgctaaggatagtttcattgacagcagcagcagcagcagcaactgtaccagtggcagcagcaagaccaacagccctagcatctccccttccatgcttagtaatgcagagcacaagagggggcctgaggtcacatcccaaggggtgcagacttccagcccagcctgcaaacaagagaaggatgacagagaagagaagaaagacacaacagagtgagtaacctgggtctcagcacatgctctctccgagtaacctgctttaaggggttttctgttccatagtaactgttacatagagctggggttagaaatctgagctgaatctagtcattgggttcttagcattcttcccattctgacttgtttgcagctgtgggggtaagaaaagctacttctatggagataagagtttaaatttgaatgccctgtctcggggttctggttctgcctaaccctgcagtctgcaaggactatttgctgccccagttgaggaaatgtttagttgataagcacatctttataaaccttatttctgtgcatctggcatttaaaagcacttaaatagataaactagtgggttagcctcagacataatcaccactccctttttgtgttctggataacaaaaaaaaaaactaattgtacttgaactatttattcttgatttgcagaaaaataattttactagagcaatggtaaacccaaggcatgtgattaaaacattttgacacatttaaaattgctgcgtatgctacaggtggtggaagggctttgttaacacagcacttgggcatctgaggctgttgatcctaagtttgaggccagcctggatccattgcaaggcctaatctttaaaaaaaaaaaaaaattagaactactgtgaactcattaagcattggtgttttatctgcctgtctgtctgtacaccacacacttgctgtaccttcagaggccaaaagagggtgtcagatgcctgaaactgtagttatagatagatggattaataaacccagtcctatggagtggcagctgtttagctgtcacttaacctcattaggcacccttttaaggggctgcgacttaccagttgaaatattcggtgattgcttttgagggatgtggtttctttggttttcatttgttctcgtatggttagtttcttcatcagattaagcagcagaggtgtgtgtttcagtaaaggagactgagacatggagagttactcacatctgctctatgtcagcaatcctctgaaagctgacgagtgtggcgcagttgagaaagccgcagccccatgatgtttcactggcctgcttgttgttttctttctttcttaggcaggttaggaaatcgacattgaatcccaatgcaaaggagttcaaccctcgttctttctctcaggtaagcgctagccttttacagctggtctgaagagacgtcactgcgctcttcatggctttctcctgagctcccatctgactgagcccagttgtaggaccctgagacagcctggcctccaggcttgtgggatgtccccaagcttgtcagtcctgctgtgccgctgtgagggacagctcagtgtaagctcacaacgactgaggctgtcaggccaaagaagcccactcactaactacacaagagagtccatttcctcgggaaggcataggagaacatgcctgtattcttagcaaacaggagaccggggcaaaagggtcatgattttgtggtcagtttgggccacatagtgagatccccaccccaaaacacaaaaatgaaaagaaaaaaatggatagaccttttctggttccttgtaaaattattacaatttttatatctttttttcattgataaatattttagcttgattagatatgatacagtgttgataccaaatctgtgtttatgccagccctctaacactgagaaatgtctgcagcctaagttttcccttttttaacccctggaaactgaatcaacttcttacatgctagcctctggatgttttgtttgcctgtttgtttgtttgtttgttttgctttgctttatctttagaataaaaaaatgctagttaaaaacaaataggcagaacaatcagggaagctgctttgaatattgttttcatagatgcttttcatcttgacagagttgatgttgaattctgtttttgttgttgttgttgttttgtagccaaagccttctactaccccaacgtcacctcggcctcaagcacaacccagcccatctatggtgggtcatcagcagccagctccagtgtacactcagcctgtgtgcttcgcacccaatatgatgtatcccgtcccagtgagcccgggcgtacaagtaagttccatgggttacaatttgctggacaccatagcttgcatttagcacaagtgtcctaggtgggcactaagtgggacacctgatagcaagtagtgttaagagtgggcagtgggtaggggtggtgtattgtatcattagcatgtggatctaagttttaggattaattttcagaaaaaaatgacttacatttactataggccagagttgttccttttagttgtgggtattaatttgaatagctcacagggaatcaagaaaacactggccagatcacattaaaagacagtgatagaatgaatatattgttaccatatgaatctaatgatgtgttttcaattccctcaagcctttatacccaatacctatgacgcccatgcctgtgaaccaagccaagacatatagagcaggtaaaggtgagaataaccctgcctgtgtttgcttgtgtctgcatgctgcatgagtttagcacctgtgtgcaatgaatagttggcttcagcttgaattcacagggtatgtgttcacttgtgatggccaacgtgagtattcaagtgatcacatagtaatcatgtgagagaaaaaaatataaataaactttgtatgtggtgtgtgggtatgtgcatgtgtgcactcagtatacatggaggttaaaagaacactgtaggagttcctcctggtgggttctaggatcaacctcaggtcatcagatttggccacaaatacctttacctgatgagccatcttgccaacccaataaatgtccatccccatcccagtcacctacacctttaccacccacactccaccctaccctacccccacacagagtctctctctctcttaccttgtagccttgactagcttggaacttactttatagaccagacttttgtggaattcctataaatcttcctgcccccccaagtgctggcactaaaggtgtgcccactacactcggccttctttttaaagatgcattttgaggctggagaattggatcattggttaagagtgcatgctgctcttgcagaggacccaggcttgatatccagctctcacgtggtgcctcacgacttatctgtaactaactccagtcccagggaatccagtgccctcttctggactccatgcataccaggcatacacacatgtatcaatatacatgcaggcaaaacactcatacacatataaatatctgtattttttttctatatatgaacattttgctagcgtgtttgtacttgtactgtatggacacacggaagccaaaaaaaggcagcagaacccctgggactggtatcacagacagctgtgagctgccttgtacatgctgggaacctgaactctgatcctctgtaagaacatcaagtgccttaactgataattctctctagcctctgtttggtattttttgccaaaagaaataaattttagaaatttcaagctgaagtctaaattgaaattttatcagaattttttttttgtttgtggtttatttggaattgttttcagccatagtctcactgtgtaaccctcactggtctggaactggctatgtagaccaggttaacctcaaacagcaatcctagagttaaaggcgtgcaccaccacactggccgctctttattgctgagaagatgctcctatagccaggctggcctcatcggacttgctgtgtagctaaggcctcagatcaggtgttggctgtgctggaactgagtctaggtggcagtgagctgctatgtgatgctgcggacattttccccaagtgctgtgtgccctgcgcacagctttactcagtgctcttgccctgcagctgttgtaatcccctcttcccagcgtatcaatcctgctgactccatccttgggcagtgctagttcaaaggagtcttaaatgccttccaaccctggaaagagggattactacataatagtcatttccaggacaaagttgggtaatttttttttttttgtaggtttgttgattagtttgtttttctggtattgatggtatttctgaggattgaacccagggcctcatgtatggtgattgaggtagaggaaggaagggagggagggagggagggagggagggagggagggagggagggagggagggagggagggagggagggagggagggagggagggagaagagagcatttaagttgcccagggtagccttacactctgcatgtgttccaagaagcctggagctcatgctgcagtcaccgagtgtagtgttctttcagtttgtgctgtgttgtgaatggtgtctgttctctcagcacagaggtgtcctgtcatctctcattgtgataactgttacagggaaactgaggccgaaggatcaggagttcaagtcagaagcacaaggtcatcttgagctacatgacaccctttacccacctcccctggacccccatctttgcgcaccacatgccttctgtagctacttcctacctgtgttgctgccatagataaccatggtgtagtcccaaattcagtcagggcactgtgatgtggtgaaacttctttcatccatctttgctttccagcaaagctttacttcattggacttgtggattgtcctgaagtagaatttgcatgagctggaatggaagtacagacatgctcctcagtgcctttttaaaggctgtctccaaagataagagtgtgttctatgctagggcattgtcaacgtacgggatttcatacttgtttccctagctggtattttacagttaacctagaggagattctctcccttcacagaggtgaaagtgaggataaacttgttctgtgtataaatggagaacctcgtgcatttccacaggttctgcgtcttaagctgctgtgacaggaatatcaactgtttgtgtcttctaaggctcaacttagaaagtcctgggaaagtagccatccctgcctatgtgattgctatatcctcatactgctgtgctgctactgaacaaatggaggtgctagacaaagacacgaagtcaagttctggcttctgagattctacaaaccatgtaaaagacacctcttcttgcatggcagtgaatctttgcataaaaccacatcaggttccccttgccataaatcacacctgcctttcatgcaccctgtgagaacacgcctgtaagggagctaacataatggggatcacacacacagagtcactgagcctactccggcctccagttctccttgtagctgtgtggatttgaacttatgtactcaggctctgagcttcatgcctacaccacactgcaagggctgaagtaagttgtctgatgctgggcaccattgccatctgtaactagtattcttttctacagtggggagaggctccttgcctgactgcgggtgcttattagcaatcactagatctagtagtaacaaccctttagttgattaggatgacaaaaaaaagtctctagatactgccacatggcctctgttgggcacaattgctcttaatagagagtcaatgacatgtgaaatggctgaaatatggttcatataaagtgtaatctaagatgaatatccattcagttttggagaaatccactatagccaagtaaatatgatgtcttttgtggagggcaggtatccatggctagtttgttcctcgttttgctttgtttgagtgtatttattttacagaggttatggatcccaaaacagcctcaaaagctgaggaccttgaacgtcattgtccttgtctcccacccaaatttccttttgttttctaacaatagcagttccattaaatgttcagccaacctttttaaatatttaaaataataagcacatagacaataatagttgctttagctctgtgactgcataaacaagccaggttacaggttctctgtgctgtaccctcatgaggcatgcagttcccagaggtagcatgacatcagaaacagacatgacagctacaatcgatgtgtgcttacgggaggaaatgcacgggtgatgcagaggacgtttgtgagtcttacacgggtcttctttcctctgtttcctgggtgttgagattaaagattcatctcttagctgacatcaggaaaagtaatttttataggaatatggaaaacacacagcaagcaatttttcctttcttaaatgcgctacttggtgtacttggtactgtatgatattggaaaacaggagagctgggcgtgggggggggggggctttcaagacagggtttctctgtgtagccctggctgtcctggaactcactttgtaaaccaggctggcctcgaactcagaaatccgcctgcctctgcctcccaagtgctaggattaaaggggtgcgccaccacacccagcttgtcatctgtttttcttcagaaaggaacctttcttgaccttcttaattaaacacgttatgatttggagtatcagacagtccctgtgttctcctcccattctaataccatctcttatgttaggaaaaccaggtgaagggaaagtcactggacagctaaactctgaaggatgagtcccttacctgaagcaagtggagcaatggctcaaagcagcaggagaggggtgggggctgggtaagacagctcagacaggcagaatcagagtttggtaacacagagcctttcagaccacacaggtgcatgaattataccgacaaggtttcattttcttttaatccgtttctttttctttcgtgcagtaccaaatatgccccaacagcgacaagaccaacatcatcaaagcaccatgatgcacccagcctccgcggcagggccacccatcgtagccaccccgcccgcttactccactcagtacgttgcctacagccctcagcagtttcccaatcagcctttggtccagcatgtgccgcattatcagtctcaggtaaggccagtggaacctaactcacttcactcctaagaagagcatcttacttcgattgtttatgggtttatgggttttttggctttgttttatggtatcagatagttaatggggccttttaaatatgtttctttttatgtgtatgcttagttttgcgtgttgtaaaccgtatgctgtgcttggtgtgtggtgcctgttggagagggcacttgctgttcttgcagacgacccgaggcttgttgtccccatacctatttcagaagatccttcggtctccatggacatctgcacacatacaaagcacaaatactaggcacatatacataaagaaaataaatcttaaattaaaaaggaaaaaattgaaaaggaagcatctgagaaatagaactgtgaaatgtttctgggaaccatgaagctaggagtcagaagtgactgggacagagcaatggctcagcagtgaggcgtgtttcctgctggtgatggggcccagcacccacatggccactcacaagtccttgtaactcctgttccaggggattcgtgtcttattcaggccccttgtagcactgcacatgtgcatgcatacactcaacatatacagtgaatctttttaaaaaagaaccttatctagacttcacatcgttcattttggcataatggatgttcttttgtctacatacagcatcctcatgtgtacagtcctgtcatacaaggtaatgccaggatgatggcaccaccagcacatgctcagcctggtttagtgtcttcttcagctgctcagttcggggctcacgagcagacgcacgccatgtatggtaggaaccattttattgtcttttctgtgtgtttgactatagttgctgtaaagctctgtaaagatattctgtttaagaatagcctgcgataggtatagtggactggatcctggctattagtggtagtggggagactaaagtacaggatcatttgagccaagaggtgagagacaacatagagactctaccttagaaaacaaggggggaaaaaaaagaaaaaaagaaaagaagaagaaaagaaaggaggagtaaaaataacctgactctttgtgagagtgagtgttgagagtcttaaaacgaaagcaaacttatgtctgacttaatggcaatttatctctactttgaatctacaattcctctgtcttgatatgtttctcctttaaaaaatgatgaaaagagctgggcgtgggggtgcacaccttcaacttgggggttcagggaaggggcaggcagatctttttgagtttgaggccagcctggtctccagagcaagtccaggacagtcagggatatactataagtaagaccctgtttcagagaaacaaacaagcaaacttgtgacgtgtaatgagagcatctttgggggaaagatgtacttaacgtccttcctgcccaagccttgcagggaagggtgtaccatacagtctttcttacttcccacatcttaccatgtagagtcgcctgttcatcttacagtatgcttgtgtgctttttacagtcaccttaaattactccgaactttaaatgacaacactataccaaacttagcacatattttttctagtgacatttgaattcttgggaaagttagataagtttgggttacttatcagttgagaagtgtacacaatgggactgagagtgtgagtgcatgcagccttgtacacactgtgtctcatcttagtctgaccccttaagtgaacatatgcagggcagtaaggtctgtgttgtggtgaacacttgatcattccgaatgctttaacattatgtaggctaactaagagaacattggccaccctgagtgtcctccctgtgtttgtgatcacatgtgtactgagcaggtgcacgcctgtcaccagtgatacatgcctgctgtcaaacacttgcctatgtgaaatcctgaggtctgcttgttccacattttgatcatggtcattgccatcgtcatcagtgtgtactgggcatttgaaataaagagtagggcaagtgctgtactttagaaaacattttcttttaagcagtcaatccattggcctggcatgggagagtgcctataaatctcagtcctgtgaacatcataaaaaaggaggatcaggtattgagacagtctgggtggcatagcaagaccctgtccagatcaaagtcctcctgtaatttgatttataaagagtggcctggtttacattttcattgatttataaagagtggcctggtttacattttcatcatgatgagtctgtccttcagtgtgtgatcagttgtactccctgggattagatcagacctcacatggaaaggccctggcggtgtctctcgctgaccttgctgtaccttgtatgcattcccacagtcttccagcttggtaaaaggcttggttgaagtgcttatgtttggacactgctgctgtgtgattcagaagtggaagagacatttctttcctcctggttttctggcccccactgggttaagaggaaactctggagctgaagtttgtagtgctttttggaacagcactgtggctgccagtgcagtgctctgcagtgctgccttcctggttttgtcatgcagtacctatataaaatgggcactaggaaatgaactgtttggggattttcccatagtcaaaaatcattttttaatacgttgacacagtttgtcagtaccttggctgctccatagatcagttatgccaaacatacatacatataagacatatatgtatgtatacacacacagtttgaaaactgttgtatggaaatactaattttgtgttcatttcctttgaaaagtatgtattttctataacccaagaaataagacacttgaagctgttgatttacaatgcagtggtgctttgtcctcagttctgctgctgatctgcctctctgttgttactggttctctcaaggcaaaggccctccttgtgttgaggaggactacatggtgtcaccttgtactctttgtgaggaaggacttctattagcagactccccttgttgcctctgccctgcaaagtgatcactgtagcgtctgtcctgctcgtctgagttgctattccagcagtggttccattttcagactcagtggtagagctgtctgactgacaagtcagccagaagaactgaatgtgctctcactagccccactcccactcctccaaaaaaagacagggtctctgtatagccctggctggccttgaacttgctatataggccaggctggccttgaattcagagatccacctgcttctgcctcccaagtgctaggattagaggtgtgaacaaccataccagctaaatattttttaacatgtatagtttaatgcagataagtttttttttaagtacaataagcataaagaaataggatttcctgtaatccttctgcctgacatctgcttgttaatattcatatattctcccagagctttaattatacccttttagacagacacattttagtatgaatagtgtgatacttaaatttatatttttatgtcatgaaccttgggatttactacccaagggcctgtggtgacatttgtgttgctgtgaaaaattatgtatcatgagtttgcttaaatactgttttatctgggtaccttgcttatgacaaggctgtttgatggatgccatgttggtctttttatcagttaacggttctctatcagataataatcttattctttttatttaagcaagtcagcgtgtggacttgctacctcagtacagaaggaaagccttccggttcagtcctgttcgcttgtaaatctctgcagcaatgcttatttacagtgctggtcacccctgaccaaacgaactgtgcgtgaatacaaaagatcactgaatgtgtcggcctttccagagcatcaggaatgcacacctcaagaggctaatttacctttctatttcccacattcagcatgtcccaaattaccatacaacaaggagacaagcccttctttctactttgccagtgagttggggtttttatactaattttaactacacagtaaacactatttaagggatacgtgttaaagtagctaatttgttggagaacattttctttctaccagacagaattattcaaagtatgcatgtctgggctggggatgtggctcagtggtggagtaacttgctctagcatgcaccaggccctgaattcattccctagtacaaaaaaaaaaaaggtaaagttaagatttgtggctctgtttgtataattcagagttttgacaaaagaactatgtcttatgtcatagcttaagaaaattggaatcaaagactgagttctttcaggaagccattttgaatacaacgcaagagtgtagctgtatgggaaataccttgttttcctcattctgggagactttttctgaactgttggtagtattttatactaagccacaagcttgtgcaaagcttaaagtactagtgagtagtgttctgggctgcagagaagtgacctcactgagattcctgtagcacaggtgaagtagttagagacacagttctgtcttagcgctatttgcatgactagaggcttaaagtgtgaaggcctctggaagtgtcctgaagcctgtaacaatgtgtggtctaggctaccttcttccctaagggagcttaggagatggagttttcctgctttaccgggaagcagatcatgggctttgataggctaattactaagagaccttttagaaatgtgtgtgctgatgtcactttgtatgaaacatgagtcctaacaaacaataagatttaatgttattaaatttgggactaaattttgggctattttggaatgactactcaatcatcagggttttggaaacatttttaccttaaattttcattaattagttgctactttttggtgcctgggataagttaacaaatagagccctttcatgtgctcttggaaaagtagtcttattgagaatgtccctgaggatttcaggagcacagtttgaggtctctagtgcagttatccttaccatcctgctggctgttacagtcatagtcatttccttggcagatggctgaaaggtcttgaatcatccctaagcactaacagcctgagcacagcttcctcatgaaaggagtcagcactaaagccagcagctgttgttggggattttagtcaccgcagtgttctgccctagtccactgcggttttgcctcgccttagtgtgatgtcttttatcccctctgccccctaaaatctccttgagttatatcccctttttggaattattgaagttggaggatcctgttctgcttattttcagtgtttccagtgctagtgatcacgaatgacttgtacatccaaggtcaaaatgatagaaactatttacagagtgaacatctggtcctgaggactgaattcgcttttgttaacctcatgacttaggggactgtttctggaatctagttaatgttaaaaaaagagttgacatatttagaattttaaatacttaagtcaagaagcgctttgtcctctcacccaactctcgggagactgtttgagccttgtaagtagtagtttagctgctgaataacgatttcagaacatctgaggggattcatggtctttctagtctcccaagtagttaaattaaccagcagaggaaaagccattcaatcctgcccttggctgagagccttgcttgccactctccaaagactgctcttggttaccttccccagtcttttctgttctgttgtttctctaatttccctctccctgattttttttttaaagatttatttatttattatatgtaagtacgctgtagctgtcttcagacacaccagaagagggcatcaaatctcattacagatggttgtgagccaccatgtggttgctgggatgtgaactcaggaccttcggaagagcagtcagtgctcttaactgctgagccatctcaccagcccctctcccgctttttattgcccttagttttgctgttgctggaattacagtgttggttcccatttcccgatttctcacattatagtcaaggggaaagggttacataaggtacttgttttttaggcctctttgagccagaaagtgagcagatggaaacatttctctggatgctcctgaaagtgttttgttaaaatgcatactagggcctggagagacagctcagcagttcagagcactggttactcttgcagaggattcaggtttggttgccagcacccatgtgtaactatatctgtaactgtagttccatgggatccagtattctgtgctggtctctgtgagcactgcacatgtgtgtgttgcactggcaaaacactcatatgcatataataaaaatcaatctttttaaaagatgtctaatagggccaggaaggtggctcaatgataagaacacacttcctgtgagagcctagcctttaaatgcccttttatataaaaataaaattttaaactggatgtggtagtgaaagtgtggccctgccatgtgaagagctaaggtgggagggtcagctgctgtcaagcttgagggttgcgtgggttccaccaagccctgcctctagttattcaatcttaagaacatggctcagtgtagctcagtggtagactgtgtacttaggatgcaggaggctctggctccaatcttaagcataaactatgagtaataaagctgtttgattttgatcctggctgggtatggtaccccggtgcggatccacttggaagatggagttggggagggtgggttccaggccaacttaagctataaaagaagaaaaaccaaacaaagaagggaaaggatcttttaattctctttccaagtgacagtatcaagactttcccattttcccagttgacagatgtaattctgagacttgatggacatagttactatgactgcggtggccgtgtttccactgcattttgctagagcttccttcagagttacttgttttcccacctgttccaggactggaactcagggccttctgtgcaaagctttgcactgagctgtgtctccaagccttttatttatgttttcttaaacttttttttagtttgaatacttgagctcctatatcctctatctttatgaaatctcataaataaacatttagggttgctttccctcagttggacttaacattgctataaaggaaacacttactaaacactggatggggctttaatgtttgtggttttagaatgagacatgtggaccagttatcaccatctagcagcctagtctatagttgcagacctgtagttgttgtctctaaaaacaaaagtcgttcttaagtgcttttcacagtcagggaattagaggatggactggtctccctgactcactgaaaacattgtgacgttaggctgccgtagttttctctttacacatctgttgactaatacagtcagggaaactgtaccaggttctaaacacagttgccttcatcagtctcacctggatactgagggacactggtgagtgagggctgtggccttggcaggtggacacacaggccatgccagctccgaccattggaaacagaatgccctgccctgcactgtgacatctcatgaatgtttcctgtccctaacccgggacaccactcagctggcacacagccagagtcctccatgtgtgctattcttggaagttttggtgcttctctgtccacatcatagctgtgtttgctgacatattatctaaagtgcatgaaactgtgacacatctgtgtgtgggcttggctgtggagggctaagggttcagtgctgagagagagatagagatagcttgagagcagtccattttctgcttgatgtttagtttgtgtcgtgagctgtccagagtcacaggagcagcgaccttcctggagttctcattcccaggctgctgctctgtaaaggcacaggttcacttaatacttgatctccttggttggtaccaaggtggggcccctcctagatgcataaagagcagcctcagggtcattgtcgtagagtcacattttaagagtgttaagaaaaactgttcctttggtatttttctagctaacaggatagagtggtcagtttcatctccaggctttttgtcaggagctgcatcattcagtagggaacagaatagtgagtgggtactgtgattgactgagatggcagtgacgttgtccttgcgcccagcctcactggtgtgtgtacagggaccgttccagagcagtagcatagcaatgtaatcagatgctgaccttgagagagaggctgcacctgtcttcatgtgggccagtgtgattggtggagttgtttctacctaagcctccgagaggaacagggattgtctgagtaaatttaaactaagtcggtgtgagtgtagtgtgtagagctatgtagcacacgggtcacgtgctggccttggtagacagagcccttccgtctgtttccagactgtgcttgctctcatggctgtagagcgtggcagtgattagagtgcagtgaattaggcatagtgggctggcagtggtcgtcagaattgtacacattcctttttctttttcatctcagtttccaccggctccctcgctcagcagtatgcacatcctaatgccgccctgcatccacatactccccatcctcagccttcggccactcccaccggacagcagcaaagccagcatggtggaagtcaccctgcacccagtcctgttcaggtaaggagaggcgtggcctgtgtgtgcctagctgtgagcagttgtgggtacgggggaggccattccctaaggttgaatgccagaaacataagtgttaaaaagctgcttgatcttgaagttcttagttaagtctaaagccctctggaatttcattcctgaaggcaagccgcaatgctgccttcctgttggcttcctcagtcccatgtgctaatggggcagtgaggccttgtttggacctgtaactgcccggctgaggcttgggcttgagtccccggaaaaggccatctgcatgagagatgctttgtgctctcctttctgcgcctcccggggtgggggtggggtggtggcctgtcgccttcactctatgaagtttcccattgctttacagcaccatcagcaccaggctgcccaggctcttcatctggccagtccacagcagcagtcggccatttatcatgcggggctggcaccaacaccaccttccatgacacctgcctctaatacacagtctccacagagcagtttcccagcagcacaacagacagtcttcaccatccacccttctcatgttcagccggcatacaccaccccaccccacatggcccacgtacctcaggtaaaccagcactagccaagtttttgtgaaggccacatagggagtggtggtcagataagcagcaaggagccagttgctccccaagccaggaaaccctgtgtgtggtgccatctgcctgtctgcccctttcctgcttagcacgtgatcttctggctctcagtgaatgttgctatggttttgtggtggatcagtgaaactgtgacttagcatttcccagctgagaccttaaacctctgagtctggaatgcaccccagtcctttccttcctgtgtctgcttcgctgcgtctctctagcctctccactgtgtatatatgtgcacacatgcagacacctctacacgggagcacacacgcgagccttagagcagggtggcaggcaggccttcagtggctctcactctgagggactgcactaggattgttggtttgcgggttagcagtgtcccagctgttgcctggttgcctctgtctgctgtgattcctgagcttggaccttgggctgtggtgcaggagaactcaggctctagagtagcccagaccgtctggggcttcccttccttccttcctcccttccttcccccagtgtaaaggctgagcttgaaagctgtggttgctgagagagccagggcagcctgggccatggagaggccctctctgtagctgttaacgtaaggtggctggatcagatgtctgctacttttgatcacagttccctgaggtgggtctcacttagaagagttcctgaatgattctatttcctgtctcagtgtgccagtgaggctctggcgaggtgtgagctaacgctgctgtgtagttgggtctcttgcagaaggctagcttgttcctgtccttcccccagagctgagagtgtagaatatgctcctgttggctggcggcagtggggagggtagccagtgtggtcagtgtgctttggtggagtgagacttaagagaatcagggtcctctaagtgtccagcagaggctgtgaatttatgtgtaagatgagctcatcccaaacctcactcatgtatttgcataagagagtaagaggctaacagggaaagcagagagccatgggcctgtttgaaggtgtgaaccagtgcttcgctggggtgatggtctagagcaatgcacaggatgggaggcaggaagccgcctcttcctgctctgcccactccctgcagagccaaggttgagattaccgaccaggtagctaacatcacctttctaacttaaatttgctgccatttggtactgggttgacccagcttcagatcactctgtcatctcagtggagccagtgactcagcctttgctccgtcagttaagcttttaaagtgaggggcctaagtgctgcttcaccctacttttggggaacccactacaactggggaagggcggaagaggagagactcaggaagctgctgagggtgctggggaggcagtccccttacaggcccttgtcagttgctttctgactggaaaagggcattgatatatctttggccatgcaccatagcaagctaagaaagtgcccttcccaccccaatagcggctgcttttggtgaagaccttgccttgtgtggtatctgagcagacgagttggggactaggaggcaacttccccatcttagccctgctggatctacctcaaggttacccaagaagtccatcttgctccttcaagagccctagtccaatgaaaggaatagctgacttgttgtttaagaaggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccttatatgacgcacccttcaggtgaggcgtgtgtgtgcaggggccgccggggcaccccgagcgttctgctcgcagaggtagaatggcaggcaggaccagtgcttcaggctgcaaacctgactagcgaggcccatccaagtgtgcacaggagggatcgtgacggtcaggaaacatcaggctctgtgtgtgttctgctggttcagggttggcttgagaagcagcagcctcattctgggtagccgatgcatgccgaggactcagttggccttcctggttatgtatgtatgataggctggacagggcagcgtggtccgtcctgagtcctttataggctgatgtggggggtttatgcccatggccaagtttgatcgtagcttggaggagagcactggtgaacacgtgctgtgtgcggactggtctgagtgtagtgttagccccagcctgtgccctgacacaggacgcccatgatgtctcgtactgatggctgctgtgacgacacctgtcttccctgtgacttggaaagcagtggtgcttggctagtgtagtgggagggggtgtgaaggcctgctccacaagcagcaagtccaggacttgtatctgaagtggtttacgtctgactggtttgtttctcctcacccccttccctccccaaccctaccttggctgcagttgggggagaggggcagcattaaccctccagtcttactcactagcacaggagtagttgacagtcgtgtgctgcggacactaggctggcgggcagtggtgcctgtgttgtttaaatagccacttttcttttttacagtacaagcccaccaccaacagcagttgtaaggctgccctggaggaaccgaaaggccaaatcccctcctcccttctcctgcttctgccaaccggaagcacagaaaactagaacttcattgattttgttttttaaaagatacactgatttaacatctgataggaatgctaacagctcacttgcagtggaggatgttttggaccgagtagaggcatgtagggacttgtggctgttccataattccatgtgctgttgcagggtcctgcaagtacccagctctgcttgctgaaactggaagttatttattttttaatggcccttgagagtcatgaacacatcagctagcaacagaagtaacaagagtgattcttgctgctattaccgctttaaaaaaaaaaaatcaagacttggaacgcccttttactaaacttgacagaagttcagtaaattcttaccgccaaactgacggattattatttataaatcaagtttgatgaggcgatcactgtctacagtggttcaacttttaagttaagggaaaacttttactttgtagataatataaaataaaaactaaaaaaaaaaattaaaaaataaaaaaagttttaaaaactga

SEQ ID NO: 4 - DNA, 69817 bp, Rattus norvegicus
  misc_feature (7353)..(7365): n is a, c, g, or t
  misc_feature (12904)..(12910): n is a, c, g, or t
  misc_feature (56081)..(56082): n is a, c, g, or t
  misc_feature (56085)..(56085): n is a, c, g, or t
  misc_feature (56251)..(56252): n is a, c, g, or t
ccaggctggcctgtgcattttaagtgctgggattaaaggtgtgtaccacgacacctgttttcaatggttcctttttacttttctcttttctgaagttactccagaatatgtactcacacctgaagttttggaattaggcacctcagatgagagaggacatgtgacatttgtctttatgggtatgggtttccttactaaatatgtttttttctagttccaactatttacccagctggaccctaaggaggaggtggctcttttaaagacaggttctcacatagtctaggctgggtgcaagttctcgagtagctgaggctggccttgaacccacagagatcgactgcctctgcctccccagtgttaggattaatggcatgggctaccacggtctgtcaaattgcttctgttttaagacttatgttttaagtctttgcagtgcttgcaaaggccagaagaggatgttagattctcctaatcttaagagttacaggcaatttcgagctaccccacaatgttgctataatagaatcagacctgtggaagaacctttaataccgaaccatctttgtggtccagaccttgaactcctgatcctgcttcttagtgctaggattgcaagtgtgtgtcactgtacctgatttttgtgtggtactggggggaaaaccagggctggctacactctactaactcagcctgtcttttaacccttaattgtaaagtttgaagggtgccaggaagttcttgggttgtgataggatcctaagagtaagaacgcataccccgggaacaaaagcccgggcatcgatgaggtgcgcctagctgcagcaggccttactgcacatggagtgggttgggtggtttgggtcaaggttcacgtccatcaattgtgaaacaggtggttggtcagagtccagtgcgaaacattggacttggctcatagccagacccaggacaagttagaagtcaggttcttcaggtttttcaattctttttttttccttctcttttcaaatggctcctgactggaatgtacaggtcagaggacaacctgtgagagttctctctatgaggacccagaggatagaacgcgggttgtcaggcttggtggcaagtgccttcacctgctgaggcactctgcaggtgacaagaacatttttacagtgtgcgaagcatagcattctagaatctctggaagaaatgagaggccatccagcctaagccagctgtcctgagtgagtgaggtgaggaagacagttggagagtggagagactaggtagtgggctgccttggagttctgctagcctgctgccgtgagttggcaaccctgctctaggcaagctcttcattgacttttcagattttgactcaagtggagcgtgtggttgctctatgaagatggaatttcaaaggctggacagaggtcccagtgcttaaggacattggccgcatgtacaggacctgggtttgtttgtcagcactcacacggctgctcagaacattctgtaacaccagttcctggggatcagtgtcctccgggccctgtgggcaccaggcacatagaaggtgcacagacatgcaggcaggcgggcgctcagccacacgtacatttaaaacaaaaaatccaaaaaacccaacaactttaaaatgggatttcagttgtgttgttcacaacgtgtggaagagaaatgtaggattccttgttatttgtgagaaactcaatcttttcccttagaagaaggcttaggttgtgcaggctctattgaactaacagaggatggaaaggattggtggaaactgtaccagcaaggactgtgcatcgtggtttcgtttgtctttcttgtcattctctaaatacagtcgtgtgtgtacattctctaaatacagtcgctacagtgtagcgtttacatttgactggatattaaatactaaacatctttgaacatctttgaattttgcttctgatgggatctcggacaaatcctctagttcacttgaaaatagtccccgttacacggcaccatttgatagctgagtttatgttgtttaatgcgggctttgtttgtctctgcagtgctggaacctgagcttaggactcaaagccactaagcaagcacacttgaccaccgagtgagccaccccagcctggcagctgagtcttgtgtgctgtgtctttctaagggagagggtggtaaggaaaggcttggtgaacaattcctgagttttgacagtgtagcccaggctagctcactgcctaagctgggattacagctgtggaccacgaggcctgccatatcacatgccagatctgacagagacgtggtgtttagaagtcaaagtgtttataattatctctgatgtttaaacattgatttatttgtgtgtgtgtgtatgtgtgtgtgtgtggtgtgtggggtgtgtgggtgtgcatgtgtgtgtgtgtgtgtgtcccagcatacatgtagtgggcagaggacagtttatagaagttgattctccttttgttgtatggtcctggggattgaattcaagtcttcagacttgtagctaatgccttctgagccttctgaaaagccctgctttaacttaattttggtagttttttcctgcagttataaacacttagttgcttttagagatggagaaaatgagagctgattggggtgtcagtcagctctgttgatcccaagtgtgtgccaccgcgccttgcttctaagagtacggctgctttgcgtgccattgtccttcagtcccttactggggtagggagatgaggtgtgctctacagccctggctgagctcacacatggcatcccactgcctcagcctctgaagggtgagtgcagccacacactgctcactacactgcaccagctcagctggcttcactctatgcatttggttttgtttatttagcttttagggtcaaggtctcactcagtagctctggctgtcctggaattcactgtgtagagcaggctgcctgcttctgtctcccgagagctgggattacatgcatgtggcactccacctgcctcaccggtttgggtttgataaagcgagttgtgtttcgtcttcctctctgtggcagtctctccctggcctggtagcacacagccactgagatttcctgtcacacaggatggccccttccacactcagcctggcctgtgtttgagtagaattagaagattatattttatgttctctttaatttaaataaaatgaagattgaatttaacaaaacaatatttattaatctttgcagaggtcggaacagtagcaaaggactgcctcagcctacggtgagtaactatatttaattggaaaatatataaagtgtgatttctaactacagactcaataataaagcaaagaattaaatctgaaattgtgctaccagtaatctatcggtcagtcagtttactacaaagctgttgattctgtgagttgtttctcggggatgtatgcttttctgttaacagtgttgtagactatgtaatgttgatgttccaggaccagagtttgcaaaggtcttgggtttttgttaggattaatgtgctgtctattttattgtctttttttttctccttggaaaataccttctggtctgacattttctaacttttaccagtgaagttaaaatagacacaaagaacatgaagttccataggagaagccgccattgattggtggttttttgtttgtttggtttttttttgttttttgttttttgttttgttttgttttggtttggttttttgagatagggttttctctgtgtaatcctaattgttttggaacttctgtagaccaggatgtcctcaaactcagagagatccgcctgcctctgcctcctgagtgccgagactaggagtgtgaaccactgcctacctgtttgtcttttgggcacagggtctactatgtagtcttggctggtctggaactttctacgtagaccaggctggcctcaaacccatagagatctggctgtcactgagtttggaaacatggttttcttgctcaggttttcttgctgagtgtgaggtggtcacaccctcgtgtagtccggcctggaatagttttgttgcctgattcagccacgttgagagaagctggttgtgcaaggtacaccctgctcaccacttctcttctttactaggatatgggttgtgaggtctttcctcactacccagctagcctttgtgctggagctgaagctcggactctttagtgtgttcggggagcactctgccatccagctgctctccagcccagctgtggtttagttttacttagtgtgggtcattgagtcctctgtagtgcaggtgtgatagtcagagacctccatgtggggactgtactcgggacatcaggacatgtgactttacccaccgagccatcacaccagcccctgtctgaggtagttggtcagttggtcagtcactctgtgtgtgtgtgtgtgtgtgtgtgtgtgtgtgtgtgtgtggtttgagacaagaacttatatgtatcctgactggcctgaaaacttcctgtgtagaccaggctggcctggaattcacgtagatccacctgcttctgcttccggaatgctggaattaaggtacttacaggcatgcctggctgtgcgtgcagttgtaaaagttggtaatcctacagtcacttaagacaacacattcctctacctggcagctagctgtgcagagcacagaccctacgaaccttgatttgtcttctccagaggtttttgctttctcacatggaggtctaagtctactgtttttgtttgctttatgtcataatagttattagttggatcttgtttgatttaattatttaaaactctacctttcttttcttgtaaggaaacaatgccacagtaaccagctcttcttcgagcattgtaatccaacttgcaataatgtttatttcttaaacattccagatttcttttgacggaatctatgcaaacgtgaggatggttcatatacttacatcggttgtggtgagttactggattattagggataaattcttttggggtgggatattacatggagttaaaatgtagataattctcaacctaatattagtgggctagatgtgataaagatgattttaaagtacattaggatgctattcagttagttataactcagcagtaaaatactcttgctaaccctcttgcgtgtaaaatagtttcatagctgctgctctttcatggaatatttcgttatgtaatggtagttggcacagaattgtgtagcttcagggttcagtttatattcaccttggagtttccggtcctgtgccggtagagaatttggtataatgttaatatgctggttaatatccgatacagaatgagaccttagagaaagtaaaaggaaagcaccgatgatggggaccacactctttactttttaaattgtatcttttagggatcgaaatgtgaagtacaagtgaaaaacggaggtgtatatgaaggagtttttaaaacatacagtcctaaggtaattcttactaagtattaatgaactcttctgtcgcttcttgcgagcatcttgttgaactgactgtggacttggcagctgagctcatgagatcgagtgaaaatgttttcctgctcaccacactctctacctaattctaataaccacttgtttttttcaaataacaaattcttactagttaatgactgggttgtataacttaaaatattgtatgtgcatatgatatgcaactattttcagacatagctcttgtgagctagaagagggtgtgcagagttacgagtcccctttaacattagtgtgtctcagctatatggtagtaagaacagccattagatttgaggagtcttctttggtgggtgtaagacaggtctaaacaggaggccacggttacctggttttctcaagatgcttactttagccataggcttaaaaagtaaatggctttgatgagctaaataaatagccctataatactgttaatcaatgtttttaacattattaatatttttattttagtgtgatttggtacttgatgctgcacatgagaaaagtacagaatccagttcggggccaaaacgtgaagaaataatggagagtgttttgttcaaatgctcagacttcgttgtggtacaatttaaagatacagactcgagttatgcacgaagaggtaggcttggttttcctcagtccagcaatggtgtaatgggctcactccagcagcagttctccagaaatcacacagacttggtttcccttcacttcacacaggatcttgctatgtggctccgactgaccttgaactcttgattctcctgcttttgcctttctagtgctaaggttgtaggcctttgcctcaagacctgggaacgagattttcttttcattttatttttttattagaggtattttttagaatatctttttaaaaaaattagtaaaaatggacgttttaatgcatttttgttagaaaatatttaaaacttaattggaaaataacagtacttttagaagcataaacatataattgcagtatgcagtttttgaaaaacatttttagatttacttattttatgtatctgagcattttgcctgaatgtatttatgtataccatgggcgtccctggtgctgttgaggtcagaagatgtcagatccctaggaactggagttgctgatggctatgaggtgctcctccctctctccagccccagtgtgcattctgttaacataatgttagccagcagcagctcacatgtgtaagccttggcttcagaagttctatctgggctgcatagtggtaccatctcaaacagaatgctattgtgggcatgcttgtgtgttttgagactttaaatataggtacatacttatgtgtgtgtgtcgtgtgtgtctccaatctgttgcaaatattgactaaagaggggcctgtgggaattggtccgccatccatttggtagccctgggagaggactttcacaactctgtcattaactagagttgtttttatgcttcagtccgtgttaacagctgtttgtgcttttgggttgaaattttcatactgaaactctgagcacagaaattacagtgtaaccccctcaccccaccccaccttttttttttttttttttttttttttgaggcaggatttctccgtagccttggctgtcctcaaactctgagatctgtctatctctgcctccagagtgttgggattaaaggtgtgtcacaactgccagctgataacagcctttctttttttttttttcccttttctttatttttggagctggggaccgaacccagggccttgcacttcctaggcaagcgctctatcatcnnnnnnnnnnnnngtatgaagggaggagggcatagaagcaggcagatctgagtttgaggccagcctggttctcagagtgagttccaggacagccagggctacatagaaaaacaaaaagcgaaaagaaaaatgcccacagtggtgcagtggttaattatccagttgtatttttctgtgctgggaatgagtgcagggcctctgcatactaaagacaagctctgctcgtcttcaaggatttgggatccttgagccagaatcctctgccaggtacacatggaggccaggtcactgttgggtggtgtttttcagaagctatcccttgttttgagacaaggtctcttgctaggactaggtgctcactgattaggctagacaacaaactttggcgaatgcctatcttggcctcctcagttcaggagttataaacacacagccacacgctgagcatggcttctatacagatgctagggattgaagttgggacttggatttgtattgatttgactgaaccctcttcccagctctgtgtcaggtctgtgtgtgaacacattgtatgtccatagcagttgctattgtttgtttgtttgttttcgaggcaaggcttttctgtgtagctctggttgtcctggaactccctctgtagaccaggctggccttgatcttagagatccatctgcctctgtctcctgagtgctaggattaccattttttgagagtaaagtgttgctatggggatgttgcttaagtgtaaaagtttcagttactaatttggcatgtctcattaaccaaataaattaaccaaataaattaagataatcagtgctgcattaaaggaagtggtctatattagagatttaccttatggctttttagtttcctggagtaaaggaagatggaatttaaccagtgcttactagttgtagttagatacaaagggacattttccaagcgatcagccctccttttgctgtattctaatttacaaaaagtcagcttatggaatggagagtaactcaagaatttaagagcactgactgctattccagaggatctggttttggttcctcacatctaaatggtggctcataagcatctgcaactccagttttaaagatacagccccctcttctggcatccttgggcactgcactcacatgcacagacataagcaagaaactcctggccaaaccaccctgcctgtggttctgggcatatgtagtatatgaggactaagcccttagtcttgaggagtgccttagctgtgtgtcttgaaggcacatgctttctttgcctttttttttttttttttgttttttggtctcagagttaaccagtgtcttgcagtttttgctgatacacgaatgtggtaggccttggtcggagatgactagtcggtggtactttgacatcagtgcttcatgaatgcagacggagatgacgtcccctggagcttctgttttcatcatttctccttaacactactgtcaggatcttgaggttgcgaggcatagtgactccatttgctattccattattcaggatactgaggcaggagacttccatgaatgaagaccagtgagatcttatctcaaaaaagcaaaaaaaaaaaaaaaaaaaaaccaaaaacaaaccaactgacagtgctggagcaatagctctgtggttaagagcactggctgctcttccagaggaatcaggttcaattctctgtacccacatgagggcttgaaactgcctgtaatgttacttctaggagatcttactccttctaggatcaaccacacccacacacacccacccaccctatgatggtttgaatatgtggcccagggagtggcaccctttggaggtgtggcctttctggaggaagtgtgtcactgtggacgtgggttttaagatcctcatcttagccatctggaagccagtcctagtggccttcagatggagatgtagaactctcagcttttcctgtaccatttctgcttgtatgctgccatgttcccactttgatgataatggactgaacctctgaacctgtaagccagccccaattacatgttgtccctataagagttgccttggtcatggtgtttgttcacagcagtgaaaccctaactaagactgatccccgagaatttttatttaagaaaataaaaagcaaaaaatcccagcagcagcaccagtgggaaacgtgtttgagtggaaggcatgagatcctaggtcggtcaccagtggggaaggggaaagtcatggaacaaccaagctgaagctgcagcactttaagggttggtcagatggctcgaagggaaaagtgtctgctgctggccctggaacccacacactggaggagaaccaactctacaagctgccctctcaacagctcacactctcctgacacaaccaatgcattcaaataaaaacaacccaaattctgtttcaaaggaaaaatcagctgagcatagtgattcacctttagcccttgggaggcaggaacagaggtaggcaatcttcccaagttcaaggccagcttggtccacatagtgagtttgaggatagctaagattacatagtggagactgttaaaacaagtttttagttttaaattctgtttattggtatgtgggcttacagagggtattggatccctagacctggagttaaaggtgattgtgagccatccggtgtgtgcaggtctcttaacttttactcttaactgttgagccgtcatctctagtcctcaggtcagggcctgttgtggtttctataaactttttactgtcatcacgagtttctaaagtgggcatggtttttatctacttgttattgggtaagaaaacagacgcatctgagtatgtggacaagtagtgacagagcccagttctttaaccctaactcgcatccgtcctcccgttgtgttgtagtgatgaacaccgaaatgaccgttcagctctttgttaacaccaaggatacgtcacagaaaagcaaaggctaaagcacggtgtctccacctgtcatcctaattttgcagaggctgtggctggaaggtcataaggtcaaggttatatcacaatatgtatacattgagttctaggtcagattggtataactgacaagaccctgtctcaaaaccacaacaagaacaaccaaaacaaagccatcgcaggtagcgtaaggtacagattattgtgtggttccagttcttctttttcttcttttcatgtctggcttttgtagggaaaaagaaaatcatttttttttgagacatggtcttactatgtagaacaggcaggactcaccactccctgctaactaaaccacaagtaaacttaatgtggcttttgaaccctgatacatactttatttatttatttcagtgtgttgttttaaaatttattgtgtgtgtgtgtgtgtgtgtgtgtgtgtgtgtgtgtgcttgatgtacaagtggaactcagaggacagcttgtggaacctgttctctcctcctactgtgtggttcctgaggttcaaattcaggttgccagctctggtggccctgtttggaagcttgatttcaacatattttagagtcattgtttccacactagggattcagaggcaggcaaatctgagtgtgaggccagcctggtctatagaatgagttacaaaatagccagagatacacacagaaaaaccctgttaagcactaagctatcttctttagctcctgtttttaagaataatttttatgggggctggagagatggctcagaggctaaaagcactggctgctcttccagaggtcctgagttcagttcccagccaccacatgggaataatgtgttgtgataccttcttctggcacaggtgtacatgcagataaagcactcacatacataaacaaatctctaaaaataatttaatgtgcatggatttttggccttcatatatatttctgtatcatgtgtgaaacgagttagagacagttgttagctgtcgtgtgtgctgtgatttgaatagagatcctctggtagagcagctaatgttcgcattgtgtcctttgttttgatgacctccctgtgtgttggatttatatggcttctctcttgcttgtctctggtgctttactgctttgtgcctttgtgtggccttagccagccaggatagcaggtcagcagatggacccagtagtacacagagttggattgtaacagcactgtgtctcctcattcatgtgttggctgtcgctgctgttctgtggagccggaggtcagtcagccttaataacagacagcaggccctgcagatatacctcttctggcctttgacggggaagcttgccaagccttagcctaaatcattcttccttccgcattggagctatttagaggtgatgttttaaaagagctacatgatgttctggtttggtgcaatagcagaacatgctttgagtctcatctcacattcagcaccaatgcttggctccagtatgacacgtatcgtctcattcagcctcttacttatgaccactccgactggaggccgcccaaagaatcactgtggtcactagacgccactttcataaaaagtaatgagcaaggggtttgtcgggaatggcctctggagtaactacaaacacctaccacttactcctcctctgcacatttgattctcttttctctggcgttgtggagggaacaacaaacccacttctccatttgtttgcccacagcattcttacccctctccaatctttcattttgcttttacttattttaagtgtatgttgtgtgtgtgtgtgtgtgtgtgtgtgtgtgtgtgtgtgtgtgtgtgttactgtgtagaaggaagaggatgacacctgtgagctctgggtgttgaactcagcctgttagccgtgggccatcctctcgggcttttataccacttgtttctggactccgcactctacctacttactactgactccttcagttctgcctgcaaattattcaagtcccctttccctgaaaagagtcccctccctcccccccgccccatacaaacagtcctacctgagtgtgtggaccctccattcagcaggtcctctgggcctcgcagactcgggccacactgagactgtttggattaccagcgcctgcatctgctttcctgatccatctctgtttgtgtttcttactggcttgtctccctcctttatactgctttctcacatgcccctacccagtgcccatgatactactcggaggccaggttgtatagggtgatggttttctcattatagtctgaggtcttaaatctgagtaatgtcttttttttttttttttttcttcttagacaagacctcactctgtagccaaggctgtccttggatttgctgtgaactctttgcaattctcttgtctgagcctcctcagtagtaggattacaggcatgagccaccatgtctctttttttgtggttttttgtttttttttttttttttgttttgtttgtttgtttgtttgttttggtttggttttgtttgtttggttgactttttttttttcttttttctttttttaagaatgcgnnnnnnntagcaactagctacgcaactagcatccactcagccatgcactgccagtgcctctgcccgtgcctggggatctctaaatttttttataccatcctatttcaaaatcctgattataatgactataatatcctcctacgcttaatattttttatgataaacaaacaaacgaaaaaaaaaacgccaaagccaaaacgcctctaatccctataaccttacttttttctatatacatacagcaaaagaattatcctttcaacgtatttttttgtatatacaactcgcaatatggagccgtatggacccagaacccacggcgattaacacaataatccaacctaagactaataccacaccccccccaccactccccgaaatcaaaaagcaaacacaagcctcacgcaaaaacgactcaccccatccacccgaaaaaaaccgacgaaaaactgcggtttgccgctaggaaaacagggagctaggagcctcgagcggcgcggcggcgatgaagtgcggtgaaaatcggcggcgccatccactgagctaaataactcccaaccctcgtttgcttgacttttaagcgccagttggtttcaagtcccccaagctccggcggaaaaattctcattatctacattaaagtctcttgcttgggcctacgcaaatacgatagcgctcatcaatgtttttgaattcatgatattagtatcctaaaacttttgggggtgggtttcaagtatattttattggtataaaaccaaaatatggtgatgtgattttcagaattaggtgatactgttcccttgcagtctctttactatagagaggaaaatgctaactctcaaaaaagtaaacagtcagtgataatttgttacagcttctacaaaaaacttaaaagcagagaaggacttctcaaaccatttctttaatcttctcatgattctgctgaaagtcaccaaccactacttaaacctccaccttcctggtggcctctcagcctcccaggccacttaggcaggagccgcagaatctgtgcagttgagccacagcggctgtgcttgcactaacagcagcctcatttcttgacttgtgtgctcacaaggttaacactgtccttcatctctatataaaaagtcatcccagagtgacctcagagcatcactcaaagctacaaaacacacaatagctagttttgtttaaaatatttgtatcccgagttcccatttttttaaaaaagagaaagccccaaagttacatagtgtgaaagctactctcaacaaggccccaggtgaccgagagccatgatggttgtgtagctatggaacagatcctcctcctttacctcattacacctcctcagtataaagttcccagggactattggtcgcagccaatacccccatttccaaagaagccaaataaggagacactgggaaaaatctttctaatgcatcggcctcaacattccccttagctctgtagtactgaaagccttggccaacacacgcagacatgaagccagtggtgttctgttcaaggacattggctgctttgaggtgctgggcagcagcctcagaggtcttggcattgtttacaccctctctgaggagaaccgtggcactctggatttggtacccactaaatgacagcccagccacacctgtagcatcaatatccagagagttcttgtcacaagtcagtgaagacaagatggcattcacagctgaaagtgctggctgccgaagcaggtactgcctgctcccatagtacagcagttacagtcaaggacaaggaccactcggagttcagggttacccagaagacccacttcagtaagctgatgtctttcaagtgttaaattcttgggatccttaataaaatgtaagggttgaatttctattccttcaatttgagggaataataaagcaaaacaagattctccaatttctctttcctgaggccaattgctgcctgatcccattggagtcactacgattcccagggtcacaatcccaaggacctgacactgcttggggaacagtttctccagggcagttcttttccttgctcttttatggccacgtcactcctcctggctgattaaagtcagaatctgccatgtagagaaccgtccatggagatcggtcttggtgggtccgcagccctacgctcactccctccacgggcagcacactctggctacccgaagcagtggtttggctgcaggaaggtaagcacgtgttaccccacctccacaaggttacccagcacataggggcctcgaggatctgtggaggaggagccgccactgcctgctggctccctgcctcatctaccagctcaaaagccctatggaggctcaggcacccaagtggccagtgcacccctaaaacatttttatagaaccacaactccatatgaagactaggagatttgggctggagagactcagtgactgtagtgcgtgctgcaccaccacagagacctcagtctggatcctaccccagtatgacaagccagggggtccagcactgtagagtgagacaggaggattgctggagcttgctggcctctagcctagtggagaaacgccaagctccagatgcagagagggactctttgtcagaggaggaggctgaggaacactctgctgcctgctggctgctgcaggagtgtgtatcccctcacatgtgctcacacacgtaaacccctaaagtaaatggaactagccaaagatggctacaaatgtctcgctgtgttcttgtcactctgtttatggctctggacagcacagtgagatgtaggggtctcttcgtcttttgagaacctttgtgaagctttttcactcagtggaactacaagcaaacttgtacatttaaataccactcaagagaatacagacgcttgtggaaatagtcacacaaatgaactattagctgaatgtgaccagaaagcacttgctaaagtgactgtcagacattcagaaagtacagaagttatcttctgtatgcccagcagcatgttgtgtcacagccttctgggggtgacacagcacacctgcatgagtatcacagcactgaggttcatgaaccaaccagtctcgttggggttcctagtgggagaagttacctaaaaggattaggaataactcaaaaaagcagctgcaccccagaaagcccaccccagcatgggcaatagcacatgaactgcagccctggggctttttgtgttgctccagacagttgtgcttgttagctgtgtgtctagcaactttttagtagggtcctcaagaatcttgcaaatcctcatccatgtttcttccccagtgtataaccgtcatagtaaacgttctatctctgaagagataccatgaccatggcagctcttataaaagcaagtaaacatttaactggagtttgcttactgtttcagaagttgagtctcttatgatcatggtggggagcatggcagcacttaggcagacatggtgccagagaaggagctaagagctctgcacgaggatctgtaagcagcagggagcgctgactctaggcctggccttttgtctgctggtttgtgaggaccccctttcctctggcaggcatagaactctggcaggtcagagcattaagaacaagaaaggggcttttctgggcctggcagtgcctccctacccagaaggcgaggcaggagggttaagactgctaagcagtactagaaaaggcacaatggcctaactggtttttacatatttcatgtaaaacactacatttctctgttaagtatgtgggcctgggtgctatggcagctgtagagatgtccgaggactgtgtgtgggaactaattctgagtgccctgcagcaataaaaatggtattgtgtggtggtcggtaccttcaatcaccgagccctcttactggggtgggtatcagcgtctggtctgtcacccccatgggcgctcctatattccagactacttactgtgtaacccaggatgatcttgagtttctgatcctgattccattaccatgacgttcccagggttcactacagccgtctgactcagtgcggagcgtccagctgcggggtttccagatgatagacaggacttttttttttttttttttttaaatttagagaatactttattagtttttgtaatcaaacccacgtagataagaccttacatatttaatacagtgtgttacccctagacaggactttaatagctcagcgctacccactttcctttccctgactgggttcagtacccagccttgcaaaaaacaataatactaaataaataaaaacattattgaagggctggagagatggctcagtggttaagagcaccgactgctcttccagaggtcctgagttcaaatcccagcaaccacatggtgactcaaaaccatctgtaatgagatctgatgccctcttctgctgtgtctgagagtaacagtgtactcatgcataaaataaatgaataaatattaaaaaaaattattgaagtagatttggtaaattggagatttttcagtggtttgaattgaaatatttagtattgtagtgtgtgatcagttcttagtgatcttgtgatttctgaagagaagagcgtcatgtttgtatactgatgtgacgccagaggtgctgtacttccatgccttaacaaagagaagaggcgaatgttttcttctgtagcaacagggaggacatgccttccgagacatgaaagtgcactagagacagaaaatagaaaaccccagacagacttgatttgtgtctcagtgtgcgtgtgcacagtaaaggtaagacttcacatctagacaagcatgtccgtcattggccagcagtattggatagcatttaggagagattagctttctgtttcccatgatttcagcacagtatagagtaagacagcaagcagtgaggcgcagacacacgctacacctggcatctgagtaatttgaaagaagagccttattggcatgtgtttggttgtctggtcaacatattggaagagagacccttagttaatgtcttccatcagtttggcccttggacatctctatgggcatttttttgtttgctgattggagaaagatcaatccctctctggggaagtgcgacctctggacaagtggctgggctatgcaaggctagcagacggcaagcccagaagcaaagcacaggcgcccttccaccacagtgcatgcttcaagctcatgccttgaagtcctacctcgggcttcctttgtgatggtctgtaatctgtgggaggaaccaaggcactttgaagtagcaaactgtatttttaaggaaaacagcatgctggtgttggcttaggttgattctttccagacactgtttgaagtggtttagtccacattaagtcctaagaagagggatatgggagacggtaagatggctcagccggcagaggcagctagtaccaaactgatgacctgagctcatctctgaggctacatgacagagggagagccatgctccagggcacatacgcttacccgctcccaccacctgccctgaagatacttaaggttgaacctttttattttattttatttctttggtgtatggataaaatgatttggttggtgtgagttgatttgctttgctcctggccatagaagcttaatagggtcttctgctctttaaccctgtcgggtggcatctgcagaaggtcctgtttcctgagcacactgcccaaggtgcctccctaggctgccttccctccctgtgctcggagtgcagtgctgctgctgctaagtcatgccttttttaaaaaatattttttacttttagatttattgtgtatatgtttgtgatcctgtatgaggccagtatggaatctcctagagctagcgttcgagaaggttgtggaactgtcagatacagacagatacagagctcatgccctctgaaagtatatgaggtgctcttcaccgctgcactgtgtcccttgccctggaagctaggattccagagcaaggtctccaccaacccttttgattcttctttgcctagagctctttatctcttcattgtgtgatcacaataaaagaataagtattgttctggctaatattgttttgtaatctaagggtcaaggcattttctgcatggttaggttgtgaatggatcttgacaaaagaaggacccactgtttcttctccccatgggttttggttagtttcttgttgctatgatgaacctgatagattgcagggggattagcctgactcatggtttcagagcccacagactgtggctccttggttcatgagctttgaagaacagtgggttgtgtgatggttgggggccttacctctaggagacagacagaaagcagaagagaccaatcaggttaccatatagggcaaggacatcagcccagtgacccactccctctaattaagcactgcctccaggtaatgccatcatacggtaaatacatcaaggggttaactggcttcacttccagccctcaggagagaactctctggaaatggacttgcagacctgtatagagatatttactgaccacaatggtatttcctaatgtagtcagttcattaccgaatcaaagcaggacgctgtcagatgcagtccgtttgaatctgtacatctgtagtcctatttctgcatcactcaatgccatttccccggcgttcttttcttggtgtctcctccaaaatttgatttcatatgtttatcattttaagaaactagtcgtttgaagcttgtccttttgaagttttttttttttttgggaggggcaggtctaagccgtgtaccctaggatagcctagggctccatttccttcactgcatctgtcaggagctgggattctggttcactgccctgccattagttaatttttcttttgcctctcccctcctttcccctcctctctcttttcttcttgaaattatgtattttggtatagggtctgtgtgtgtgcctggtgaatctgaacttgctatatatacccggctggcctacgtctgcctcctaagtgctggggtaccacactgcaagagttccttttgtttccttctttccttcgttcgtttgttctttttggatttttttcttttaaagaattatttacttatgtataagatggttgtgagccaccatgtggttgctggaaattgaactcaggacctctggtggagcaaactcacttaaccactgacatctctctagcccctccttgttgagttttgatttctctagacagggttgctctgtggctgtcctggaactcactctgtagaccagactgggaactggctcagctttttttttttttttttttggttctttttttcggagctggggaccgaacccagggccttgcgcttcctaggtaagcgctctaccactgagctaaatccccagccccctggctcagctttttcaattttttttttttttttttttttttttttttttgctttagcaaaaattatataccccatccaacccctccaaagtccctttcacctatttttctttggttccttacctatgaaagtttagactgtggaggtttttattcctggccttttgggccctttatatgcttatggttttggttatctgagacaagggctcatctgggcctggctggcctggaacatgctatgtagaccaggctgcctctggacgctgcaggcgctgcaagcatacgtgaaggcaaacactcaaacatatagagtagaaaatgaatttccgattacacgttgctgcactgtgtgcctgcttctgttcagagctgcggtgtcttgttcctgtgccagtgtagtaagttgaatttaaacgttttatggatttattctacctgtatgaatttgccagcatgtatataccttgtgttcttgaggtcagaagagggtattgatacctggaactagttacagatggctgtctcagtgtgggtgctaggacttgaacccaggtcctctgatagagaaactagtactatccctcaaaatagatactcttttttttttttttttttggagatggggtctcactggtgtctctggctggccttgaattcagacatcccaccaccaccatgccttaaagcatgtggctcccacacctggcaaggcttcatatgctcttagggcatttacagacaggcttcttgtcagcgttccttcctgtttcccccagcgtggatggccttcttgagttcatctgcctcatttatcctcgggtttgctgtctactaaaagcccgtgcactccagagaatgatagacatgctttcaaaaccaagtcagcctctcctcctcagactcctgagcatttttgcactcactgttgatctagtgctcacacagtagctcttcagccggacgttttattattaatttgccaaaatagcctcaataatgtgctgggttgcagctgatgcagttgacatggtttctgtaggctgaggagaatgggggtttcctggagccccaaactgctctttctcctgactcctggggcgcgtgaggaaatggttggagaagcagtggtctgctggggggcatagctagctattctaggccctgacagttttctgtttacagagataaagatgtgtctctcttttgtccttactgcataatcattcctccagatgatttcttaatcctcagaaccaaacccaaagcagtcatttattattttttataggcatatcgatagaaagattacattttatttaccattcagttctggaaaacataagaaatctaaaaatgttacttttcagtagcatatttaagcatatttttgtggtagcagcccatttctagtcattttgatgaactttcttaaaggacttatttaatgttttgttttataagtatatgtttttgcttacatgtctctctatgtagcatgtacatggctagtaccatagaggccagaagaggcctttagagcccctagaactgaagttaacagaagattgtgagctgcctcctgagtgcaagaacagcaggcgctcttcactgctgagccatctttccaacctgcataatacactttagacaatgaaaacaaattctaacgcgttagatttcaaaagtaagcccagcgcatggaattctttcttcactgagcataagtaaagtgtgcatagctctttgagggttaaactttgccttagtgcttatatgcttatatgcatgtccatgtgtccactcagtgtacccgctgtgaaggagtgcatgaaagtaacctggctgcggcttagtttggagtcctagggttacgaggtcccctgaaggtcatccctatacaaccccttctagggcacgcacgccactagtgggttaaagtcagtgttctggaggcaggtagacatgattacctaaaaaggtagtgtcctgttatattgtggattggaagtttgttgtctttgaatttctctttaaacttggtatttggggtggctttgtttctgatttttgctgtgatgcctgtcctgcttcccagaaagttttgacaaattggtgtctccagtattgtttgttagggtgatgtcctaactgctagtgagtccggttggccattaagaatttccggggctggggatttagctcagtggtagagcgcttacctaggaagcgcaaggccctgggttcagtccccagctccgaaaaaaagaaccaaaaaaaaaaaaaagaatttccattaatgcaatgatctttaaagatgagctccacctcaattttgttcccagagaggcctggattcctgccccagtgaacgtcaaacatagcctgggacttgattttattttgaggtcgtagttctttctatttctctgctttaaagtttctagtggaaggaacaactgttgactatgatggtacccctcagagccttgcgttttgtgtttatgtgtttaatgatttctacagtatataaaacaaaccgttttctgacatttaatcaggtaaatagtaaatgtgttttgttcagtggacgtagtcattcagaatggatggtatatttgctattggggttttttttttccctgacaaaacaggtgctattgctctgtgctggcatgcagaagagagctgtgtatttctggcatgcactatgttgtggggagggcctttacacatcagatgtaagttttcagcgacatgtgtgacagagattgggtttttagacagcttgttttgtttccatcagagcagtgtcccactaggcaatattatccttcaacgtcctgtgtggcagcttatgtaggactgtcggctctgagcacagccatcatgatcttcacagcactcactgctcttctattcgcctaccctcctatgtttcttttcttggttgcttttgttttatttttaagatgtatttgattattttatgtaatcaattaattaatttaatgtgtgtgagcacactgtagctctctttagacacaccagaaggggcatcagatcccattacagttggttatgagccaccgtgtggttgccgggaattgaactcagggcctctggcagagcagtcagtgctcttaaccactgagccatctctcaggccccaaaattaacccataaactctacttgcccaaggaccaggtaacttcctagaattctggggatcataaagagccacatggaaaaatacggtggctgtatgggtttgtcctttaaagtccctacagcacatgtctcagggccgctcaactgggaattataatgagtggtcctgaccaaagtcattcctggttagtatttaaataaagcttgcttcaaatttggcttgaatatgtagaactggttttcctctctagagtctcaggattaacatttggaggccccagtgagtgtaaaaagacctttccacctcaaattctggagctaggcttttcactctggctctgccctgtgcataaaggcacccccccccccccactgcctcccccaaaggccaagctggggaaaatgaaatagcaagcaattttttatggtaagtcatagaagcctctttagctagcttccgtgacaattttctgcctgttctttggatagtggattcgggatattttatctgggaatggggaggacctgggaagctctgtgcactccctcacccccaccccacttcaggacaaaggcagacatcccacgacagtttgtgaggccttggctgttccggaattagctctgtagaccaggttggctttaaactcagagattttacctgcctgtgcctccatctcctggtgagattaacttcctgtgtcaccacttcctggctttattttaaagtgcgtgcgtgcgtgcgcacctgctcatgagtgcccatgtagaccataggtgtgggatcccctacagctggagttaacagatggttgtaaaccatccaacattgattggcgttgggaatcgggtttgggttatctggaagagcagtatgtgctgcggttaagtgcctgaggcatctctccagtcctttgaagatttgtttatttgagggacaagatcttacttatcacaggctggcttggagtttttgttttttttttttttttttttttttttttttctttttttcagagctggggaccgaacccagggccttgcgcttcctaggcaagcgctctaccactgagctaaatccccaacccggagatttttatgtagctgagcatgacttctaacttctgttcctcctgtccactctggctgtatcctggggacggcaggcactgtgccatcatgcgcagtgtactgaggtattttgaaacagaaaagagggctcgtttgtttgccgttatacttgtgatgcaggggcttgtgcattatagccatgcacacaactctcccataacaagaaaaggtggcatgcatctatattccttaagcctgaggagagatactctcagagttgtaggctgccataccagactatttatgtgacaaagttctgtctccaaaaaaggtatataatttgtgtggctgtgggacagtcttctatgcttttaacttttaccatgttgtcttcttccttttctttgttcctttttctctctgtgtctgtctctgtatgtgtgtctctctctgtctctctccggtccacccccaccccgttctctcttttttttaaggtagggtcttaatgtatgtattgtatagcagtgaacctcctgcttaagtctcccagtttgggggctcagctccccgctttgagttttaacttcctgaatgagaatgctagtttttttatgctgagtttgtatttatatagatttttttactcacttaaatgcatgcttttgaaaaactagtggttaacatgttaacaagattttgtttttggaacagtgttgcagcttttacacagagatgactgtgactgctccaagtgccttggaatctacttctgtggttttagtcttttggttaaaggaatctcaggatcctaacaaatactatttgctgttattgttgtaatctctcctcttcctgaaagtgtacatgaggatatacattttttctttttttttttttcttttttttttctttttttcggagctggggaccgaacccagggccttgcgcttgctaggcaagcgctctaccactgagctaaatccccaaccccgaggatatacatttttaaaaagtttactcagatgtatcttcatctgagtgcaggtgcctgcagaagccagaagagggcatcaggtctcctagaatagagttgcaggtggctgtgagtctcccagtataggtgctacgacctgaacccgggtcttctgcaagagcagagccatcagccatctctccagctttatcagttagtttttaccagtagttgatggagtgtcagatgatgtagaatagagtgagtcaagctagcagcaagtaatgaggctacttatttagggctatttgtggcttccagttggtggggtgttgggagatgagcagcatcccccccccccccccccgagctggggaccgaacccagggccttgctcttgctaggcaagcgctctaccactgagacaaatccccaacccctgatgagcatgggatcctgtgcaaaaagctttatctgattacagttccgttctgcttctgtgtctctgaggggctccctgtatgtattccttaggtgctggggaagtaggcagctcgtatgtatggtgcacatccatgtctataagcccctcatttgggaaggctggtggttaggccaggctagctagctgtgcagtgctctgcttaaaattttccacccacatgtcttactttggcaataccttgatctttgggatactaatgcatgacagtgccagatcaaaccctttgagtagtcagttttgtagaataattctacatgttaatggtactttattctcctactctctgtatcaacttgtagtaagggttggggcacaaagagtttgggagcttgtgtctctggcaggatagaggcattcctgtgttagatgtgtgaccatgtgtatccctgttgctgtttagctctttaactcctagctgtagagcagtaaggtcagctgagcatgggggtgctggacatttttataagctagactcctcaagggatagtaggaggagtgggacggggtgcgtgtcagtaagcctaggctactagaagttggcatgagcctgtcccacacaggcagcactgcagaatctgagcagcttcttttttggttttctgagacagggtttcactgaacttgctctatagaccagatatggccttgaactcagacatctgcctgcctctgctgcctgagtgctaggactaaaggcgtgggacaccactagcccgcttgaatctgagcttcttaaggtggtattgaggaaatgttttggaaagggacagatcacttacgaatggtcttccttaatacacataccagcgggaggcccctgtgcagagacctaagcttagaaagctaaaaccattctgcctagtcacacatggtgtgggcacttgctagctatcccagcactggggcaagtacatgtaggaagagtgctacaagttcaaggctagcctgggctacatattaggtttcagtccatctagggatacatagaagacactgtctcaatacataaacaagacaactaatgtatttggctacagatacttagtgtcacctgtcttcttcacagatgctttcactgactctgctctcagtgctaaagtgaatggtgaacacaaggagaaggacctggagccctgggatgcaggggagctcacagccagcgaggagctggaggctctggagaatgatgtggtgagtgtcctctgagactgctcagtgtgctctgcacaccccagccttcaatgtaaacgtgcatctgtcacagggaacacgtttagagcagcgctttctctgggcagttgtgaaagtaagaaaaggaaagaatttctccttgactggagttccgagcactcataaatcacttctttgtgatgatcagtttacttcagcacactgacagttaagagactggcagcctgtattgttttgaataccaacaaaataagcagcctaaagcaggtagtgtttaattgtatgttggcttccttagaaatgaggtcaagttggcctttttgtttgagcaagagttatcattaaggtagtttcaagttgggtgtggcaactgtgatgtcagcactcagtggtagaaaaagaagggttaagagttcaagatcaacctccactaaagagaaagtttgaggccagcctgaactatataagaccctgactcaaaacaacagaaaacaaaacaaaacaccgaaacaacaacaacaaaaaccccaagtcagctaggtgtcgagttacctgcctttaataccaggaggcagacagacatgtctacatagttagtttgaggctagctacagctactcagccagactgtggatgaaaaatagcaatcataaaagataaatacttaggttacattaaaattaaagcattgcctaaatttctctaaaatgagtatcatcatctgtagaatcttccttctgaactgtgcattgatcttgtattattttttgttttctcttgacattccatttatagagcttattatattttctttaattaaaaattttattttatatgcatgggcatactgtatgtatgtctgtgcacctatacctggtgccttgagaggccagaagagtttgtcaggtcccctagaactggagttacagacaactgtgaatttgcatttgtgtgctgggaattgtaccggggacctttggaaaagcagcctgtgcttacaagcattgagccatctccccagtcccctagagcatagagatttaatgttaaggagtgccgtgcagtaagtaaggttgagtgaataaagaaccttctgttgtgagcagagaacagagtttactgcctaaggcatagtaatatagtgaatagcatcttcttctccaagagccctaccacctaaaagaacagaactgccctgccctgggaagtcatcagtattaatcctcggagtttaaaggatctcctaaacttagcataatggttttcaagtgtatatcactgtaccattgaagtgggaagcaggtacagttttactttattagttagggcagtaagttctttaatgctttgggggggaagacgctggcagttttatcaaaatttaaaatgtaaatgtggtttgttctattagtcttactacgaaggatttacttagctaggcagtttggattctgagttcaaggtcagcctgatctacatagcaagttctaggccttcctggctaccctgtgagaccctgtcttttgttttgtttttgtttttaagatatatttatttattttatatatgtgagtacactgtagctgtcttcagacacaccagaagagggcatcagatcccattacagatggttgtgagccaccatgtggttgctgggatttgaactcaggacctctggaagagcagtcagtgctcttaaccactgagccatctgtccagtaccctgtttttatttttttgggacagggtttctctccatagccttggctgtcatggaactcactctgtagaccaggctggcctcaaactcagatccacctgtttctacctcccaaatgctgggattaaaggtgtccatcaaccacctcctggcttgagaccatgtacttttttcttttccttccaaaaatgggattatacaaatttaaaatataaaataatttaccttaatcctaatatatctataatacatgtaaataattatgtcatgatattttttgcaacattatttctattagcaggttcacatcagaaaagcataatactaatacctaatagaaatatgtacctaccagtattcaaatgagaaagacaccttacatacttattaacagaaaaggcaagctgcagaatagcaacactgtatttaaattttgaaactacattgtgttgtgtgtgtgtgtgtgtgtgtgtgtgtgtgtgtgtgtgtgtgtgtgttgggggggtgttatgtgtacagtggaatgaagaccagaagagggcattggttacagggagttgagatccaccatgcaggggctgcaaatccttttgtaagagttcttagagcatatttttgttgttgttggttttttgtttgtttttttttttggaaacagggttttcctctgtatatctggctatttgaactcagatctacctgcctctacctcatgagtgctggggttaaagacctgtgccaccatactgagctctgtagtaacagctcgtaaccttggaaccattggcttaagtctgggaaactcctaatagtggttatttctaagacctggaacttggaatcattagttttggtgggtatttttcagttgagtggaatgaatcactcaaattactgaagttataatcttccaattaaaaaaaaaaacatctgcgggttggggatttagctcagtggtagagcgcttgcctaggaagcgcaaggccctgggttcggtccccagctccgaaaaaaagaacccaaaaaaaaaaaaaaaaaaaaaatctgtcttttgtatcgtctatcaagagtcagagaatgtagtgtgagtgtgtatcatggtttgcatgcagagtcctagaacagcttgtggggttggcccctcttcctcaccatgtcctctggaaatgttttcttgactactgagctgtcagcctattggactttaaaaggagagtcggatgtgaggcttctggggtccaggagttgcctcacaaactatatgaatgctgacctcagacagggatggtttattgagtgtttgccccaggattgattgaacgtggcagagcagactcaagagctggctgtgacagtgagtcaagatcctgtagggcttttaagcctgagatctacgaacatctgtgcctcggtattccactggtcaggattcaggggcagggtcgtgtctttgttgtacatttaccctgtttccattggtctcggtattcagctgtggcaggggacttgcttgcctaacctaacattcatgacttaacttgccaatcaggaggtcagttgcctgtgtacatgtctctttctggaggtaggatgtcaactctcaaggaggccttgggaacttaaacttgactccaccctactcaaaatggaagtcttattctcaaaagcttcttatactggtactggtgtctctcttatattggggtttatccaaagggctactcatcaaagcaaaaaccataaaagttcatgcatatatgtaggaagtgctgcttgggtggttggtttgggtggctacctgtacaaagcagttctgactaacttctgttgtgattggtttccaagacaccaaagcacggaagtcacagaatctgcaatcaactagagcatgagaaagttcccttatgacattagtaacagcacaaaatggcagactagaaaggtaacagttacctaggcctcaacaagattgattggcaccgcagattctggctgtattttcctcatatcttcagggtgaagagaatagcctatgttttgagagtagcggttgactccttcagtgatggaggggacagtactgaaggtggaagtcaggacaatgggacccgagctgttgctgagctccttgcaacctttcatggcaaacagctttaaaacttagcctgtgtgacgtcccatttgccttcccatgactttatgctgtccttcctcacctgcctaggggaggggaaggggaagggaaggtatgcttttgtgctggcatggaaatctagaagcttgtgggaactctgacccagaggccctggatctctgacaactcatggaatcccccaccgatttaaagggatgatccacatcagagaaaagcttttcctaaagagttattttttgtttttgttagatatagggcttccccccaccccccttttcaactgtagccaaggctggctcttgaacttcaaacgtcctcttttctcagcctcctgagtgctgctatgacaggtgtgggctgcgtctagcttttctttaatgatttctaaagtaaagtttggcccttttgtagggaaggggtcagagttagagccaactagtacagtttgcaggaagttactggaaacattgattgcagctaaattgaaaagttgaccttcattttccttctagtctaacggatgggatcccaatgatatgtttcgatataatgaagagaattacggtgtggtgtccacatacgatagtagtttatcttcatatacgtaagttcacagagtttccttttatttattttagtgcatttgtcaattttcatcaacttaaattacgttactaatttttttttaattttaaattaaataaaaatatcacattgttttttattaactattcatactgatagactcacattaagatagggaataaatgttgttccatttcatgatcaaaatacattttgtctttgtttttaaattgtaaaaatgttcaattttcagggatgagggttagagtaagccagttcttgaaacggtaaatgttcttctgtataacagcaacactaaaaaccgtgttttggtttgtgatggcaaagcccctaaccccgtcagtgcccttgaccctgtactgtagcgtttcttaatggctgagagtggaaaactgatcactcgtcttctttcctgtgtatttagggttcccttagaaagggacaactcagaagaatttctaaaacgggaggcaagggcaaaccagttagcagaagaaatcgagtccagtgctcagtacaaagctcgtgtggcccttgagaatgatgaccggagtgaggaagagaagtacacagcagtccagagaaactgcagtgaccgggaaggtcatggcaccaacactaggtactcagactgagccacatgcattgtcatggacccgattcaaagtctgtgtgagaagatgtagtctgactgtttcctctttcatgaagctaaggagaaagtgctgattgatttgacttacgattctgttggagagctggatggtggtggtgcaggcctttaatcccagcacttgggatacagagttcaatacccaccttcccaccttggaccccccctccccttacacacagatttctgttagagaaaaaattacagtcattttaatagtatcttttgggattagctctctggagtcaagtgttggacccatgtgactacctagcccagaccctgaggagctccttgaaacaaggtccgagtggtgcccggtggcctagtggcagtgcactgtggcttgcacgatgaaggtctgttcagagcatcagaatatcggaatggggaggaactagaattgccttgtacttcaggagagcctcaccaggagctgatactttcgatatgataatggtgcctgtctgccactgggagtgtggggataatgtaatgtcacctctgcagaacatggtactgtaagagaatctggcctctttaggggtaaagactaagaacccacagtcaatatttgtgatgctgtaatggcaggtggcagaagcacttgtgtgctgtgcttgaagagtagcctacagggaagagtgaggaggaacaaagacgctgagtcagagagctgtcagtgtgacccagcactgcagcagaacgtggcaagctgccagacagactctccccggcacagaggctaggaaactagggaagagctgggtcttacttgaaaattcagcttttcatgatgcttgcacacgaactaaagacagtgtggcatgaattcaaatggagaaacgatggtgcagtggttgcacacatttgcagggctgtgggtctgtcacttattcagaacatgtagaaaacctgctgccttgtgggtaaagctgagtctgccgtcaaggctccacagctgagtcttctgattccctaatcctcacagagtgtcagcatgaaagtgagcacacttagttaaagtggtgggcggccaagacctgcagggctgtgaggcagtgtggcaagaccgaggcttgtgtaagaaatggttttctatctaatgtaccttccagtgtgttttgttagcctagcactttttaggataaatgattaagagcatctctcatttccagggaaaataaatatattcctcctggacaaagaaacagagaagtcatatcctggggaagtgggagacagagctcaccacggatgggccagcctggaccaggctccatgccatcaagagctacttctcacacttcagatttcaacccgaatgctggctcagaccaaagagtagttaatggaggcaagtattttgactatatttgctaatgtttcttatcagatacagagctatctaaacattaagggttacatacatgataggaatgtgcatgccatttgtgaatttttggagtagtttttattacctataatgtagtttgttttgtggctaccggacagtataacactgtaaccgtccttggcgcgtgtagggtgacagcatgtcctgagctgtttcatcctctcatactcatttggcctaagatactccacagacaaatagattggaaactcgtaaagcactgggtgataaggctatgggagtaggaatagttcatgtggaagtcacggagttagtgcagacttgttttcatcaactgtgataggctccatcctgcctaacccaaggaagaacttggggtcatttgtaataacagaaatgagcaagagtcatgtgacgaaagtcatcagaattgtgcttacaaatacagcacagaccacctttgatttcgagggtaggtgtgagagtgtagcagcttagatctttaagtaggaagccactttctatagtgcccccatagtgtccccagtcagttgaatacagattataagtgtgtatagaaatctggaagatgggacagcagaagtgaatcatttggaaacctggtaactgacagagaaagagaacgagtagacagccaatgtggtcaggggttgaaggttagagcagtgcaggcttgatgaggtagaggaggaacagtcaaaggctccagaggcagtttgagccagcctgggtcatgtgagacctcatgtaaaaaaaaaaaaagggaggggagaagagtgtcagccgtgtgagaacaggcgagcagaagaaccctgggtttccagttgtgttcgtttttgctgagtcttctctccagaatccctctgcaaggaagcagcactcctgaccatttccctacttagtaatgatggtgaaatttctttgctcattgagtgaagattttcagttgtttatgaatagaattttcaagttaaaaacacgaagggagctgaggtctgtatgatagtcccgtgtgtggagtcccctggactactggagaggaaccctgggctgtcgacaaacaccagggaagtctgtgccctgtgcttcctgttgtgtgcagacaggagatggatagctggagcccagagcagtatgttgggttgagatttgctttacagaagcagaggctgctgttctagcattctagaaaacagtagaggtaaggtgtcatttctaatgaaactggtatttggttcaggggtagacctgaggaacgtcagttgagagcaggaaagagctttcgacggcggcttcggtggttgctgtttctctcgactgttcagagcggagactgctgaaggctgccttcccaagcaggagtcctgtgtttactgaggggttctctgtgtgtgcgacattctcttcatgagggacggctgacagcagctgaagaagtaggcacactaggcagagtcttaactgtctcttcagtagtgtgtgtagatcctaattaaccctttgggaacgtggattcattcaaacagacttaatttaaggaggttaaagtaaaatgtgaatttgtgtcagttaagttgtgctaaaacttatcacaaatcaaatgactgtcctcaaagggttaaatgtacaagaaatcatttttgtcattttactttttttctgtttactttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgaggccctccagacccccgtctcacccctctgctcatggttctccagctcctgtctctactatgcctaaacgcatgtctgcagaaggtacaataccacgatttgttcatttttgtttgtctctgtttagctccgtcgtgaggttatggttacaaatagtctccttttcactagttaataacctgtaagtttgtgttgtaactttagtttattgaaactttctattagccttttgctcactagagtcaaatttggcaagtgctctgagtcaagctcggcactgtccgggatgtgaagatgggtctgacccgtctgcggtagtgcacctgcgcagcccaggaaggtcacggctccggctccaggagagcaacggggaccaactgggcactctctgctcttggaggtgggtgggggtatgggggctgccacattcagctccctggacatggtgccagtgaaccttcctgttggccaaaggcaggagtactattttggggtcctttgtgatccatgacatcccttgtagtgaccttgtatgtctgccctcgggtaacagtagtttttagagtgcctgaggaattactaattcaattgaataactattttaaattagttttacattatcactatagtgaaaggctgctttaatttgagagacctttatttaaagtttatcagttacaaaacagatacagagctgaggcttttctgtctttttggctcttgtcaaattgtatttgatgctgaattcaccattgttggatgtcatatactctgatgggtgacatatgtctgtaatccagtgcccaggacacaggcaggaggatggccaaaagttgaggtcagtttggctcatttaatgagctctaagcctgctaggactatatggtgaggccctgcccgaaaaaggtagcattctgatttagtgcagtttataagttaaagcatcttttgttctgaatgacaatgtcctcaattcagagtgtttgtgtgtatattctaatcaccttgtcttggtaaagtcataacgaatacggctgagcaagactgataaagttttccaaagaagctgttgcaatcttgaaaaggcaaatttcactgacttttattcaatgcatgcctctcatagtggctcctagcagcaacatggaggtctgttgcagaccattagcataaagatgcttactccacgagaacgttgcagagagcactgagcataagagaattgtgagcattgcactgtagtcagacctaagggctgcttttggactgcccagaaagcatgctccgcagttccgggtgctggtgcctcaggtggaagccctaacagagggctagatgactgaggtttggtctctggaactcatgtaaaggtgaaaaaagagaaccgactccataaagttgacctctcacttgtacacacatgctatatggcacgaaaaaccccacctcataccacacacatagatttttaatacattttaaaaattaagaaaagggggttggggatttagctcagtggtagagcgcttgcctagcaagtggaaggccctgggttcggtccccagctccaaaaataaagaaaagaaaaaaaaaaagaaaaaaaagaaaaaaaaagaaaaaaaaattaagaaaaggaaaggaaactcctaatgctaattagcactttctcaaactgcatgtctgatatgtccctctgaagacacagcagagagcatgttagctgcctctcatggcccctgagaggggtagttctggacttgtgtttttagtctgacttagtgggctacaggccatcttcacagcagtccctgatgggtggcggagtcagtgatgtgagtgtgtcagctcgaacagtgcagctttctgctcttacacgacagacagctggaggcatgatttgtaaaattggtaatcatggcaaaagatggagaggagaactgaggtttctgcttaaaatcctttttccctggagccctaaaggacatagctcagaaatagaatgctagcctaatacatatgggctcccgagtttggttcctatcaccatcaaaatcatgttttgtctcattttggaagtaatacaatgttgtagaaaggtaaactgataacatcccatcatgcaggtgtgattcctactgaggttattataactcgtttttaaacgcaagtgtagttatacactgttatgccatgttgtttgatttctcaccatcaagtttacttctcccttgctttaaaaaggaaataaggctagaaagatgggtgagttgttagagaacttcctgtgcacaccctcactcacacagacacatacacgcagtagagttaaagtaacaacacatcataagagggagaagtaagatgtacgtgcataattgacactccacgaaatcattcttagtatggccaaaaaccaatacagtgtggttcatattttaaccattgaaaatctgttaaggaagtaagagcatatgtctgtgtctagcaaaaagagcagtaaggtagacgctgcaggactgatgtgacatccttcgtgtcttcctcaggcccaccaaggatgtctccaaaggcacagcggcaccctcggaatcatagagtctccgctgggagaggctccatgtctagtggcctagaatttgtatcccacaatcccccaagtgaagcagctgctcctccagtggcaaggaccagtcctgcagggggaacgtggtcctcagtggtcagtgggggtaggtatgacattgtgacagctgactgcacacgtacagtagggcggagctgaagatctgagaggatgtacagagatacaaattaaatgtggccttagcaggtgttgccagttatcacaggtacccaagacactagttgaaggacctgtcccatccttctggacctctgtccctgtgtacattttgtaaacctgtctaggtttcttattgcagcgtgtttccatggcatctgtgtgtggggtaaacagatgctcacccagtgctcctcagggggcgtgcacagcaggccttcagctcttatgtaggggcctgagacatactctggccgtcagcagccgcaatctgtcctgtcagcctatagtgcttcacttcccgggaacagagcggagcagtgcctgctcttctggccttaccagagacaggcctttaagcttaaaaaagacagacagacagacagacagacagacagacagacagacagacaggcaggcagtgctgttaaacgtctgcttttatttgctacgccctcacacagtatgtttatcctgtgtggtctgcacgtgtgggatcacctataaacccctttgtgctatttttcttgacctttttaactgaagactaacaagaaaatagaaggtgagaaaagaatcttgagctgtttgaaccttataaataagcaactttattataaatgtgagtagagacagttgagagggatatagtaagaattgtgttacaggttggggatttggctcagtggtagagcgcttgcctaaaaggccctgggttcattccccagcctcggggggcggggcgggggggggggggattgtgttacagggttggtctttcctggagaagttagagacatgaacagtttccttctataatgtttgtgacttcaaaaacaaaagtcactaaagtgatgcaaattgaaccattttcactaacctctttagtctgaagtctgcaaataggtttttaatggactaagaaacattaggcagttgtgtggaaggcactcggtctgtgctgcatacacctcgaggctaattgcgtcctaatttccttcagcactagcagtggatctttttattgcaaagaaaagcacacaggcttgcagcaggctgccatcagtgtactgatggaaggagagggagaggcttggtagaggccttctctcatcttacataaatgtcacactctggatgttgtccttttttattttttatttttttaagtatgatttggcttgccattaaacccggtgttgaactttcctcaaaaatacttcaaagttaactcattgaatttaggagggaaaccacagtggcacatagatattggtgatttctgtcataagatattctgagaatttaatgagtgcctttttgcttctagttccaagactatctcccaaaactcacagacccaggtctcccaggcagaacagcgctggaaactctcccagcgggcctgtgctcgcttctccccaagctggcatcacccctgccgaagccgtttccatgccggtccccgccgcgtcccctactcctgccagccctgcgtccaacagagctctgaccccatctatcgagggtatgcaaccaacgtggatggccaagagctgggttctacatacacggtgacacaaagttctgtctgcggtagaactattccatgtatattagctaatatctggcgtcagaggcgctggcctgtcctagtgtgataggcctgttacaggagcatgcttactgggtttccatgtgatgactaacaaggaataaactcaaaagtgaacccatttccctaagctacattacatgtgtttgctgtttactcacacgattgtcctaacttctgtctaatactagtttgtttgctttttttaaacttgttttctagcgaaagattccaggcttcaagatcagaggcagaactctcctgcagggaataaagaaaatattaaagcaagtgaaacatcacctagcttttcaaaagctgaaaacaaaggttagagtttgttaaagtttttagacacagttatagaaacagaaaactatttagccagaagatatttgaaattgctagtctttaggtgatagatctcctctctttttttttttttaagattatatatatatatatatatatgcatgctgtcactgtcttcagacacaccagaggagggcatcagatcccattacagatggttgtgagccaccatgtggttgctggggtttgaactcaggacctctggaagagcagtcagtgctcttaaccgctgagccatctcttcagccctctcctctcgtttcttatctcctcccctcaccccagtgctatgattaaagctgctatagtcgtgcaccaacacaagtggcctctgctctcctttctaacattccgtacttaacagttttacgtttaaggttagaggagacttgggatctaacaggtttcggttttacaggtgtgtcaccagttatctctgaacacagaaaacagatcgatgatttaaagaagtttaagaatgattttagggtaagttctgtattgattggttagaattaaaaaaaatagcagttggtgattttaaatgaccagttcacaaaagcatgttcttaaagtgcacacacatgcacgcacactgtcattttaagtcatttgtgcaacaaactaattgtttttcagctgttgtttatgtatgcattatgcatttgggcacgggtctgcctggtgtcctgtgagaccagaagagggcactggatttcctggaactggagttgcagatggtcatgaaccaccatgtaggttctgggtcctgaacccaggtcctctggaagggcagccagtgctcttaaccactaatgtctctttctagcccacagggtttaaatgtgtgtgtatgtatgtgcgtgcatgccatctggtctggtctgcctgtctgtctgtgagttgatatgtacatagtagttcaaatgccctccgaggccagctgtcgtcccttggagatggggttaaaggcaacagtgggctgcctgaagagggtgttagaaagtgaatttggattctctggaagaacagcaaacactgttaaccactgagctgtctttctagccctttcacaattactcttaaagatgtctttctctgttctaagtacaaaaatttgaaatcacaaggtttttgtttggggtgtgtgtgtgtgtgtgtgtgtgtgtgtgtgtgtgtgtgtgtgtgtgtataccaagactgcaggtagcaaatgaaaggatatcttactttggaagctgacacactagagctcactgcttcctaggtctaaggttgagaattgaccctgtcagtacttgtagtgtgtgcagtagaagatgtaactcattctaatttttttttaatttattcatttattatatatataagtacactgtagctgtcttcagatacaccagaagagggcatcagatctctttacagatggttgtgagccaccatgtggttgctgggaattgaactcatgatctctggaagagcagtcgggtgctcttaaccgctgagccatctctccagcccgatgtaactcattctcttattcattcatgcttttgggggctgaggcttgaccccaggcctgaattcccttggtgagagtgttcctataaatctcacttctatcctaagacaagcttctagagccctcctgggttactttgtcattcttccacacaaaatctacaaaaagctttagtgtaaggggctggggatttagctcagtggtagagcgcttacctaggaagcgcaaggccctgggttcggtccccagttccgaaaaaaaaagaaccaaaaaaaaaaaaaaaaaaaaagctttagtgtaaataccaaattaatttaattttttaaaatggtttctttgtttttactttatgtgcattggtgttttccctgcatgtatgtatgtgtgaggatgttgaatctcccggaactgtcgttaaaagcattgtgagcagccatgtgcatgctgggaattgatcctgggtcctctgaaagagcagccagtgctctttaaccactgaatcatctctccttcctcccaaattacattttagaccagtaactttttatcctttgaattctatactgttgggtttttgtttgtttttgttttaagaattatttacttaggttatgtatgtgagtacactgttgctctcttcagacacaccagaagagggcatcggatcccattacagatggttatgagccaccatgtggttgctgggaagtgaactcaggacctctggaagagcagtcagtgcttttaaccacttgagccatctctccctacactgctgttttttatttttattattttaattatatgcatatgtatctgtgtgttagagtggaggtattcacagggaccagtggggtggtatttgtctagagctaactaatgttccctggcctgggtgctggaagccatactctatcctctgggagagaagagtacatgcccttaaccactgagccatccatccatcctccccaccaaattgtattaaataccagctcagggagtctcaaagtttagctatctagaaggaaacatcatgttttaatatgtctgtattaaatcttaaagctcacaaatgagaggaaacatgcactaattgtcttttctgagttaatttgcttaatctggtactctcctgttatatttattttcctgtaaaggatacaattttttggattaataaatccaagagcatacatgccacattctttttttttttttttcttcttcttttttttggagctggggaccgaacccagggccttgtgcttgctaggcaaacgctctaccactgagctaaatccccagccctacatgccacattcttgttagtctctcctctgtgcatagtcacctcggttgttgtgtagtagctgctgggaatagcactgaagctgtgttgatgaggaagactctcagtggcacttaggtttgcagtcctttgagaagaatggctgggtcaaatggcaggtctgtttttaagtttttaggatttcgggttttttttcaagatatactttatattttttatttgcgtgtgtgtgtgtgtgtgtgtgtgtgtgtgtgtgtgtgtgtgtgtacacgtgcagatgctctggagctgaacttgcagacagttggtaagcatgagcccatgtgggagctgggaattgaaccaggtttcctgggagaaccagccagtgctcttaaccactgaaccatctttccagcccactattgtttttagtccacagaactgggcaactttacattctcacctgaattgttctctggtgggagaaagagggggttctcttttttccacatcttcactactatttgctgtttgtttctaatgactgccattctgacagagttaagtgggtatctgagtgtgcatgtatatatatcttgtctaaaataagcgtgtgtgtgtgtgtgtgtgtgtgtgtgtgtgtatacatacatatacatatatatttttttttatttaaattgtaggggtgtgtgtgtatgggtaagtgtgagtaagaatgaggatgctggtgaggtcagaggctttgggagtttggtgtttaactctcctgaggatcacagtacttaactgctttctttagacttgctggggagctctcgtctatgtggttccccttaactatgtgaggctcacactcagtcttaggctgtgtctgtcacgcagctctgcatcatctgttctttttccctgtcctattttcattgtttttttccagctttgatttgagcttagtttgttgtttgttccttttctgggatattcaggtacagcattgttgcttagttgaggtcttatcaaattctttttatttaacttaatttaattttttaaaatttttgtttaattaaaaaaaatttagtgcttaattgtttaaagtttaggtagtggactggagagactcagagattaagagcaccgactgctcttccagaggtcctgagttcaattcccagcaaccacatggtgactcacaaccatctgtaatgggatctgatgccctcttctggtgtgtctgaagacagcgacagtgtactcatacatagaataaatcttaaaaaaaaataaaagcttaggtagcaatggcattaggagttggtctctaggagttgatcataccttttctttctttttttgagttcctggccaatgagtaaatgctaggaagtagagcaggggttccaatgccgtgtttgaattttaattgctctaaatgcgaaatcttgtcggttgtttacattcagtgattcctgagtttcagaccctttcccctgcttctgtcccagcccctcctgtcacagtgatactgtaaagcagtttctgtcgctgcctgctgtgtgtgcatcaggaaactgagttggtgaagttaagtcagctgcccaggaaactaggtgactgggaaatgaaaggcttaggttaaggggagtgcagacgagttcagccgccattgtgacatgacatgtaggttttgtcctgaactgcccttctttctcttgagagcagtctccactctgcagcatagctgagtgctggaagttttatatggagacttcctaggtctggtgggttaatgctttgtagattatggaggtaaaggttttgcttgaagcactgtgcgctcagggtattgcctaagggacgtcccaggcagaggagggaagggtagagactgggtcttgacaagtttttttctttgagttacagaaaggcttggttttgggtagggtttagctctgtgcttactgtggactaattgagttctgtcccaccgaacacacataacccttctctacagaattttaattgtactttgttttctccatgggcttgccatttataagatgtccattaaagaacctatatcgtgtggattaagaaataacatgtgtgtgtgtgtgcgcgcgcgcgcgcagaggcaggaggactttgaattagctctttattctacttttacatgggttccggtccttgaggtcaccttttcaggccctttcctttgcattttcatgaagattcagttttgttttatgtgtttggtgttttgcctgaatgtgtaagtgtactacatttgtgcctggtacctatggagcccaaagaggacaccagatcccttgaaactagaattgtagagattgtgaccatgcaggtcctgggtactgaacctgcaagaacagaaagggcaagtatgtactgagccatcactccagtcctactttttaaactgttgtatggttactgagtattgtactaggttccataagcacatttatataaatgtctatgatgtactctgagcatatgccatctcctgctccttagtggaggctgctttttctctctgtcttgcgtggtagccttccacctccctgaggcaggggtcagaactgtcgcatcttgttccatcagccacacagtgctggtgttgcgggccgctggtaaatacttaacttttccttccttttcctgaaacagaatctctgttgcccaggacggcctgcgacgcccagcagacctatttctgcctctgaaattctgaaattgcaggcatgagccaccatcagtttaataactaagccttttgtttgtgccttgggggaggcaggtgtgggacgttgagacagggtctctgtacatagccctgctttcctggaactcaatatgtggaaaccaaagtggcctacaactcacagacctgcacctgcttcctgagtgctgagactaaaggcttacaccaccatggtcagcctggctaataactagctcttgagtcttggatactggttgctaaagttgtattgtatgttattttggtttttgtgccttaaaaagacataatctgagtcgggcatggtggccttcagttccttcctccttccaggaggcagaggaaggcagatcatagtgagttcagggccagcctggtctacgtagggagttcctacacacagagaccctgtctcgacagacagacagatcaaccaaaaaggtcattttctgaaaccagtaacagaaaacctattcacactcctttgcttatacttatgggaaattatttcttatatttagttacagccaagttctacgtctgaatctatggatcaactactaagcaaaaacagagaaggagaaaagtcacgagatttgatgaaagacaaaacggaagcaagtgctaaggacagcttcattgacagtggcagcagcagctgcaccagcagcagcagcaagaccaacagccccagcgcctccccttctgtgcttagtaatgcagagcacaagagggggcctgaggtcacgtcccagggggtgcagacttccagtccggcctgcaaacaagagaaggatgaccgagaagagcggaaagacacaaccgagttagtagcctgggcctcagcacatcctctctccaagtagtgtgctttaaggagtttgttttcgcagagtaaccgttacagagacttgctttagaactcgtagctgaatctagtcattgaattcttagcattgttaccattctgttttgtatgtagctgtgacggtaagaaatgctacttgtgtacagacagtttaaatctgaaagccctgtcttgggactcaggttctgcctaccctgcagtttgcaaggactgtgtgctgccccagttgaggaaatgtttagttgataagcacatttttataaaccttatttctgtgcatctgccgtattaaagcacttaaatagactagtgggttagcctcagacttaatcacaactccttttttgtgttctggataacgaaaaaaaccctaattgtacttgaacttttagcatggcaggtttagagtgactgtttattcttttttttccccggagctggggaccgaactcagggccttgcgcttgctacgcaagcgctctaccactgagctaaatccccaacctgtgactgtttattcttgatttgcagaaaaataattttactggagcagtggtctttcccaaggcatgtgattaaaaaatcttgatacatttataattggtgcctggtggaaggaaggattttgttaacacagcacttgagcagctgaggctgtggatcctaagtgtgaggccagccttgatctattgcaaagcccaatctttaaagaaaaacaattagaaatactatgcactcgtattaagcattggggtttttaaagtggattaattttctgtgctttgtctgcgtgtccgtctgttgtctacatgtccgtctgtacactacacacttgctgtaccttcagaggccacaagagggtgttaggtggctgaaaccagttatcaattgagggattaaaccccagtccttcggaggggcagctgcttggctgttccttaaccccgtcaggcacccttttaaggctgttttccatggggctactgtgttctcagttggaatattccttgattgcttttgagggatgtggtttctttggtttgaatttgttcttgtatgattactctcttcatcagattgagcagcagacgtgtgtgtttcagtgaaggagactgaaacagagaattacacaaatatgacctatgttagcaatcctttgaaagctgatggctgtggcagagttgtgaaagccgtgggttccatgatgtttcactgacctgcctgttgttttctttctcacttaggcaagttaggaagtcgactttgaatcccaatgcaaaggagttcaaccctcgttctttctctcaggtaagcgatagccctctatagcgagtttctgcggagattcagggtggtcttcatggcttttttcctgtgctcccatctgactgagcccagctgtaggacgctgagacagcctgtcctccccgagcttgccagtgttcgctgtgcagctgtgagaacggaggctctgaagagcagctcggaatgtaagctggatgattagtgaggctgccggtcccactgactgcacagaagagaatctgtttcctgccctttggaaacatttcctcagggaggtgtggtagagcatgcctgtaatcttagcaagcaggagactggggcaaaagggtcatgagtttggtcagtgtgggccacacagtgagaccgtgcccaaaaccacaaaaatgaaaaagaaaaaaatagaccttttctggttccttgtaaaacacagttctgataccaaatctgcttatgacagcccttaacactgagaaatgtctgcagccttagttttccctgttttaatccctggaaactgaatcagctacttcaatgctagactctgggtgttttgtttgttttgttttgtgttttgaatacaaagtgctagttagatatgtactggcaaaaccactagggaggctgctgtaaagattgttttcatagttgcttttatcttgacgtggttgacactgaattctgttttgtagccaaagccttctactaccccaacgtcgcctcggcctcaagcccagcccagcccgtccatggtgggtcatcagcagccagctccagtgtacacgcagcctgtgtgctttgcacccaatatgatgtaccctgtcccagtgagcccaggcgtgcaggtaagttccatgggttaggatttgctggactaccatagcttgcatttagcacaggggtcctgggttggtactgagtggatacctgatagcagggaggggtaagagtgggtggtgggtggggagggcttggtgtgctgtatcattagcatgtggatctgagttttagagctaattctcagaaaaatggcttacatttactgtaggccagagttgttccttttggttatgggtattattttaatttgaatagctcatagggaatcaggaaaacacaggccagataacattaaaagacagtgataggatatattgttaccatatgaatctaatgatgtgttttcaattccctcaagcctttatacccaatacctatgacgcccatgccagtgaaccaagccaagacatatagagcaggtaaaggtgagaatagccctgcctgtgtgtgcctatgtgtgcatgagctaagtaccactgtgcactgagtagttgactgcagcttgaattcacagggtgtgtgttcacttcggatggccagtgtgagtgttcacagggtgtgtgttcacttctcatggccagtgtgagtattcaattcacagggtgtgtgttcacttctgatggccaatgtgagtattcaggtgactcttgagcagatagcacatggtactcatgtgaggggatatatatatatacatatatatatatatatatatatatatatatatatatatatatatatatacttagtatgtggtgtgtgagtatgtgcatgtgtgcacttggtatgcatggagattaaaaagagcactgtaggagttcaccttgtgggttctgaggatcaaacttaggtcatcagatttggccacaagaaccttttctactgagccgtcttgccaaaaaaatgtcccagcccatccccatcgccttcttccaccaccaccactaccaccacacacatagtctctccctttcactttgtagtcttggttagcctggaacttgcttacatctgcctgcccccaagtgctgggattaaacctggccttctttttgaagctgtcttttgaggctggagacttgatcattggtcaagagtgcttgctgctcttgcagaggaccgagcaaggcttggcatccagcccacgtgctgcctcgtaacctgcagactcaaggagcctagtgccctctctggcctccacgcaccagctatacagtgtcccgacaggcgtgcaggcagagcactcatccactacagatagttacagtattatttctgttgtctgtacatgacactttgccagcacgtttgtgcttgactgtatgacgcatggaggacagtagaagctcgggaaccagaatcccagacagttgggagccgtcatgtgcacatgctgggaacctgagctctgatcctctgtgacatcaggtgcctgaactgataagccatctttccagcctctgttcaggatcaatgaattttagaaatttcaacctgaagtctaaaatgaaaatttaacagaatttttttttgtttgtggtttatttggaattgttttcagacatagtctcattgtgtaaccctgactggtctggaactggttatgtagaccaggttaacctcaaactcagcaatcctctgcctctgtaatacctggaattaaaggcgcataccccaccacactgtctgttctttaccactgaggagattctcctgtagccaggctggcctccttgaacttgctgtgtagataaggccccagagccctgaggggagagggcactggctgtcctggaactgagttctaggtggctgtatgctgctctgagcagcaccctccctgttcctatgcagaagcaccacagtgtggacccacgagttctctcctgctctgcacacagctcagtgcagctcttttattacagcttttgttctgtgtgtcttttgctgtcccctccagtgtgttgttggttggctttagttttttccagcatatcactcctgttaactgcatccctgagtagtgttagtttaaaggagtcttatgagcctccagtcctagaaagtgttattactacatagtagtaatttccaggacaaaggtttggtggtggtggtgatagttagttttttggttttgtttttagttttttgggttttgtttgtttgtttttgatgggtttgttgggttagtttgtttttctgatattgatggtatttctgaggattgaacattgaacccggggccttatatatagtgatttaggtaaagggagggagggaaggaggaggaagggaaaagagagtctttaagttgcccagggtagccttaccctctgcctgtgttccaggaagcgggaaagtcatgctgcagtcacaggctgtagtttgagtttgtagttgtagttggtctttcagtttgtgctgtgctgtgaacggtgtctgttcttacgcggacgtgtcgtgtcatctctccttgtgatcagctgtaactgtattgcacgtatctgtaatccaacacttgggaaacggaggcagaaggatcaggagttcgagtcaggagcataagatcaccttgagttacatgacaccctttgtccatctcccccgtctctgcatgccacatgccttctgtagctacttcctgcctgtgctgctgccatagatgagcatgctgtcgccccaggttctgccatttgccgtgcgctgtgacgcggtagcactcctttcatccatcttggctttccagccaagacttcgtgtgttgcaaagctttacgtccttagactttgcattatcctgaggcagagttcgcatgagctacaaggaagcacagtcatgcgtcttgcttctttgtcaggccgtctccaggataaaaatagtgcgctgtatgtctgggcattatcagcgtgaggaactgcatccttgtctctccggctagcaccccgtaaagtcagaagttgacctagagagtctcgcccttcacagagggagaatagggataaacttgttctgtgcataaatggaggacctcgtgcatttccataggttctgcgtcttaaactgctattccaagaacataacagtttctatcttctaaggcaaaacccagaaagtcctgggaagtagccatccctgcctctgtaattcccgtactgctgtgctgctactgaacaaatggaggtgctgggcaaagatacttctagcattttccaaatatacgaagtcggtaagccacgctttcttgcatggcagtgaatctctgcataaaatcatgtcaggttcctcttgccatcaatcacaccttcctttcatgcatcctgtgagaacatgcctgtcagggaattaccaaaaaggagatcacacacacgcgcaaccagagtcattgagcctactccagcttccagtgctctctgtagctgtgtggatttgaacttctgatcttgcctcatgtactgagcttcatgggcacaccacactgcaaaggctgaagtaaactcctgatgcttgctgccgttggcatcggtaactggtgttcttttctacagtgggagaaggcgcttgttgactgagggcgcttattagcagtcactagacctagtagtcgtacttccctttacttgattagggtgacaaaggcggcctccagatactgcaacatggcctccgttgggcaaaattgttctgatagaaagccagtgacgtgaaatggtaaaatatggtttatataaagtgtcgtctaagatgaatgtctttgtggagggcaggcatccatgactaggttgtgtcttgttttgctctgtttagagtatttattttgcagaggttatggatccccaaccagcctcaaaagctgaggaccttgaatgtctgttgtccttgtctgtctccacctccctgtgcctcaagggtaggtgtgcgcggtctctgctggtccatgtgctgctgggcatgggcctaggcctaggacaccacataaagctttaacaaaagtgccaacgtgttgcagtaaaaaccggttcctgtgcataccttggcagttgcgctctcgctagttctggctccagcgggccattggaactaacactaatttctctcagcagctccacactgcactcatctactttctgacccgggcagtcctcgagccatcacaacacagcaccctgtcaggctgccccgccctcactcacagctctctgggctggtttctaccacgacagccagcatacacatcccaattctgtggcgggcccagtgcatcttgaactcagttaagtttccacgtgaaagaacacatcacacaatatcctctggtccaattgataagatatagtttgtccatctagacaacacaaaatcctgtacacatccatcccttaagaataatcataacattctgtaatatgttcagagaggaatcttaacatctgccgccatgttctctcagttcttcctccttgctctgtcctcctctgcctaaaactttgctcccgcccatcttgccttctcctccaatgacaggccttgttctatcctgtacctgccctcacctgcataaggacatcaacctacagtgaagagactttactgagattaactaggcaaatttttctttgataaaagtaatatttaggtttatgggttttccccactcaatcaaatttcctttcctttttctaatgtacggactgtcaatattattttgggaaatttttcataatactgatttcttctattttcaggtttactttctaaatagataaagtagcattttcattaagtattcagccaactttttaaatatttaaaacaaacacatagacactaacagttgctttagctctgttgcctgagtaaagaagccatgttccatgttctctgtgactgtggcatgcagttcctctgcagttagcaaacagacctgacggctacagttgatgtgatgtcctgggaggaagtgcacagtgacacagagggcgtttgtgggcagtacatggtcttctggcctctgtgtcctgggtgttgggactaaaggtgtgctcagctcttagctggtgtcaggaaaaggaacccattcaggggtatggaagacacagcagttctttttgtgtagtgttgggtggcgttgttgattagaaatctgctacttgggggttggggatttagctcagtgatagagcgcttgcctaggaagcgcaaggccctgggttcggtccccagctctgaaaaaaagaaccaaaaaaaaaaaaaaaaaaagaaatctgctacttggtggacttggtactgtatgattttagatgaaatgaaggagagctgggctgggcctgtagctcagtggtgggcctgtttagttccagaggtccaaagcttaataatggctctgacaaaatacaaactggatgggagtaaagcaggagtggagtgacgggtgtggattggtattggcttttttgtcatctgtttttcttcgggatggagcctttcgtgaacttcttaaacgttataatttggagtgttagtccctatggtctcttcctcctcccatcctaatgccgtatcttatgaaagctacaacataagggaaatcgctccacagctaaacctgaaggctcaatcacatgcctgaagctgaggggaatcgctcagagcagctggagaggggtgggagctgggtaagacagcttttggaaggcaggctcagagtctagtcacacagccttgtagaccacccacacaggtgcatgcagtgtacccaggaggtgtcattccctttcaatgcgtccctttctctcctgcagtaccaaatatgccccaacagcgacaagagcagcaccatcaaagcaccatgatgcaccctgcctccgcagcagggccgcctatcgttgccaccccgcccgccgcttactccacgcagtacgttgcctacagccctcagcagtttcccaaccagcctttggtccagcacgtgccgcattatcagtctcaggtaaggccgaactcgttcactctttacagaagcatctcatttctactgtttatgtgtttatgggtcttttggctttgttttatgctatcagatagttaaggagttggggccttttaaatggctttcttttttatgtgtatgattatttttgcatgttttaaaccatatgccatgcctggtgcacttggggctggttgcagagggcaggtgctgctcttgcagatgacccccctgggttcattgtcctcatacctatttcagaagatcctttgatctccatgggcatctgtactcataaaaagcacaaatactaggcatagccacataaaataaatcgtaaaaagaaaaaaatttgaaaaggaagcgttgagaaatagaactctgaaatgtttctgggaaccatcaagtcaggaatcggaagggactggacccagtagtgtttcctgctagtgatagggcccaggcttggttcccagcaccacgtagctgttcagaccccttccagcactgcacatacacaacccagcacgcacacgcacacatgcacacacagagtgaatctttaaaaaagagtcttaactagaattctcatcgttcattttggtataatgttcttttgtttaaatacagcatcctcatgtgtacagtcctgtcatacaaggtaatgccaggatgatggcaccaccagcacatgctcagcctggtttagtgtcgtcttcagctgctcagttcggggctcacgagcagacgcatgccatgtatggtaggaatcattttattgtcttttctgtgtgtatgactagagttgttttaaagcattgtgaagatactctgtttaagaatagcttgagggagggagggagggaaggagggagggagggaggtgtagtggtgtgactattctggctactagtggtggtggacagactaaagtacagtatcgtttgagccaaggagtgagagacaagcccgggcaacatggagacctcagaaaacaaggagtaaaaataacctgactctttgtgacagtgagtgttgagagtcttaaagcaaacnngcnattatgtctgacgtattggcagtttatttctacgttgtacctgcacttcctctgtcggatacgcttttcctttcataaatgatgagataagctgggcgtggtggtgcgcaccttcaatcctagcactctggggttgggggcctataggtctctgtgagttcgaggnnagcctggtctacaaagcaagtccagggtagtcggggctatatagcaagaccctgttattaaacaaaacaaaacaactgatgatgtgtaatgagaaagcatctttgggggaaagatgtactttccttcctttctgccccaggtcattctgcttatcctgcctcagccttgcaggaaagaaagggtatagtcctccttcctacttgccacgtcttaccaggtagggtcggatcgccttatggcgtgctgtgtgctttgtacagtcaccttaaattactcccaacttgaagcactataccaaacttaacacacattcttcctagtggcatttgaattctttggaatgttagataagtttgggtaattgatccagttgagaagtgtacaccgtggatctgacggtgtgagtgcctgcagatgtacagacactgtctaatcttttcagtttgttgccttaaatgaccatatgcggacagttaagattctgtgttctggaaaacacttgaaagagtaacgttgtctaccctgagcgttctccctgtttgtgatcacatgagtaccgagcaggcgcacacctgtcaccagggtagattaatagttaggatacattaagatacttaggatacatgccatgcaaacagttgcctttgtaaaaaagaaacctgaggtctgcttcttctcattaacacagagtttaatgagatcactgtcactaccatcgtcctcagtgtgtgctcggcatttgaaataaagagtagggcaagtgctgctgtattttagaaaatatcttccaagcagtcagtccattggcccggcatgggcgagggcctgtagatctcagccctgtggacatcatgaaaaaggaggatcaggcactgagaccagttttagtggtagagcaagacctgtctcagataaaagtcctcctgaaatctgatttataaagggacagcctggtctcatttatagttcgaccatgatgtgtctgtcctccagcctgtgttcagttgtactccctgggattacatcagaccttgtgtggaaggccctggtgctgtctcttcctggctttcctgcaccctgcatgcgtttccacagttttccagattattaaaagactcggttgaagctcttccattgttcggacactgctgccaactgcatgcttcggaagtaggagaggcctccgttctgctgttctcggccccgttggactagggggagactttggagctgaagattctagtgcttttaggaacagcactttgtggctgccagtgcagggctgtgcagaagctgcctccctggggctgctgatctggatttgcctttgtcatgtaggtctgatgtcaaacacacactaggaaaggaattgtttggggttctcccacagtcacaggtttgccttgtcagtcgtttcagttacttcggctgctccatggaccagttaggctaaacgtacatactgtttggaagttgttgtatggaaatgctacttttgtgttcgttttcttggaaaagtatgcattttctataacccaagaaatcagatacttgaggatgttgatttacaatgtagtgcggctttgtcctcagtccagctgctggtttgcttttttgtttttgtttttgtttttgttttgttgattgttactggtgtggtcaaggcggactatgtgttgtcaccttgtactctttctgaggaaggacttccattcacagactcaccttgttgtctctgcccccacccccaagtggtcactgtaacctctgttttcctcatatccagtgtcctgctcatctgagttgatattactgccatggtttcattttcagaaacaatgatagagctgtctgactgacagacaggtcagccagaagaactgaatgtgttcttactgtccccacttccactcctccaaaaagacagggtctctatatagccccagctgtccttgagcttgctagataggccaggctggccttgaatttcagagatccacctgcttctgcctcccacgtgctaggattagaggtgtgcatagcacagcaactaaatatgttaatatgcatagcagacaagtttttagtacaataagcataaagacataggattcccataatcctcctgcctgacatctgcttcttaatagtcatgtattctcccagatgctttaattaggccctttagacagacacattttagtatgaatagtgtaatacttacattcttatttttatatcatgaaccttgggatttactacccaagggcctgtggtgacgattgtgttgctgtgaaaagttatgtatcatgaatttgcttaaatactgttttatctgggtaccttgcttatgtcaaggctgtttgatggatgccatgttggtctttgtatcagttaatggttctctatcagataataatatattctttctatctaagcaagtcagcgtgcggacttgctacctcagtacagaaggaaagccttgcggttcagtcctgttcgcttgtaaatctctgcagcaatgcttacttacagtgctggtcacccctgtataagcgaatcgtgcgggaatacaaaagagcactgaatatgtcggcctttccagaacatcagcagtgcacacctcaagaggctaatttacctttctatttcccaaattcagcatgtcccaaattaccatacaacaaggagacaagcccttctttctactttgccagtgagttgggtttttatactaattttaattacacagtaaacactatttaagggatacatgttaaagtagctaacttgttggagaatattttctttctaccagacagaatcaaagtgtgcatgtctgggctggggtgtggcacagtggtggtagttcttgctctagcatgcaccaggcccggagttcattccctagtacaaaagaaaaaaggaaaagtagagaattgtggctctgtttgtataattcagctttgacagaagaactatgccttagcttaagaattcttggagtcaggaatcagatctttccggaagcagtctgaatacaacgcaagagtgtagctgtgtgggaaatacctcgtgttttcctcattcaggggagccttttctgaacaattttacaagcttgtgtagactttaaagcactagtttatagtgcctgggactacagagaagagtccttagtgagattcctgtagcacaagaagatgaagcagttagtccgtttctgtctgatctgggattgcatgagtagaagcttaaagtacggggagcagatacatccgtggtgcccagagcgtccttcagtgccgaaggccccaaagcgcaggccttgaagcccataggctgcccccttccctaggttaacttggtagatggatttttcctattttcagggcagtgttttaaaatgaagcagctttggtagactaattactgagagaccttttagaaatgtatgttgctgaagtcactttgtatgaaacatgagttctagcagacattaagacttaatgttcttaaattaaggactaaatgtcgggctattttggaatggctactcatcatcagatgcagggttttggaaatatttttaccttaagttttcattaattgtgccgagccaaaattagttgctgctttttggtgcctgggataagttaacagatggtgtcctttcagacgctcttagaaaaggagacttgttgagaatgtacatgacgactttaaggacatagtttgaggtctctttaccatcttgctggccctgttatggtcacagtcattcccctggcagatggctaaaaggtcttgagtcaccatccctaagcactgatagcctgaacatagcttcctcatgagaggagtcagcaccaaagccagcagctgttgttggggattttagtcaccacagtgttctgtccctcgaccactgccattttgcctgggctaagtttgatgtcttctatcccctctactccctagaatttgctccttgaggaggagtaataataataataataatacggggttggggatttagctcagtggtagagcgtttgcctagcaagcgcaaggccctgggtttggtccccagctccgaaaaaaagaaaagaaaagaaaataataataataataattccctttggaattattactgaaggtggtggatcctgttttgcttattttcagtgtttgcagtgacttgtgcatccagggtcaaaatgagagaacctatttacagattaaacatctggccctggggactgaatttgcttctcttaacatcttgactcaggagactgtttctggaatgcagttaatgataaaaagatttgacgtatttagaattttaaacacttaagtcaggaagcactttgtcctcacctcacccagctctcatggaggccgcaagccttgtaagtagtggtttagcaaacagcggtttcagagcttctgagaggattcatggtatttctagcgtagagcagaaaaccatttaatcctgcccttagctgaaagccttgctcattattctagaattctgttcttgttcaccttccccatctctgctttctttgttgtttttataatttcccctctcctcactttttactgcacttagctttgctgttggtcgaattacagttttagattcccatttccccagtttttcatattttattcacggggaaagggtcacataaggtgcttgtttttagactctgagccacacaaagtgagcggatgaaaacacttctgtgggtgctcctgactgctgtgttatgttagagtgcatgcttgtgggcctcagcaggtcagcagtgctcacttctgctgaggactcaggcttggttcccagcacccttgtggctgctcacagccatctgtaactccagttccatgggatccagtactctcctctggtctctgtgagcactgcacacatgtgtgttgcacagacaaaacactcatatgcatacaataaagaaaacttgttaaaagatgtgtgatagggccagcaagatggcttagagtttcatctccagaatccacataaaagcagaaagagacaacctcctctgctgacttgcacagagagccatgtaaccttcctccactccatcccctggcgcgcgcgtgtgcccgcctacacacacacacacacacacacacacacacacacacacacacacacacacacacacacaccaataataattttaaggtttttaagagcctttaaatgtccttatatatataattaaattcaaaactgaatgtggtagccagattatgaccccaccacatgaggagctaaggtcggagagcctcttagaagtccaaggtcaggctagagagatagctcagtggttaagagcactgactgctcttccagaggtcctgagttcaaatcccagcaaccacacggtagctcacagccatctgtgtgtcacaacatcttctggtgtgtctgtgaactcatatgaataaaaaaaaattaaaaactcttaaggtcattttcagctgcttgtcaggcttttgggaagcttgggttctaccaatccctgcctctaattaattacaaactcttaagaacatggctgagagcatagctcattggtagactgtgtgcttagtgtgctggaggctctggcttcaatcctcagcataaactgtgagtgagtgagtactaaagctgtttggtcccgatcctggctggatatggtgtcctggtgtgaatctacttggaatctcagggatggtgggttccaggccatcaagctatagaggaagaaggaacaaggggaaaaaaatcttttaattctctttccagacgacagtgtcaagactttgcattttccctgttgacaaatgtccttctgagacttgacagacataattctgtcgctgcagtggctctgctcccgtggtggtggtggcacagcattcactagagctcccttcagggtggtttgttgtttgcccgctgttctgggactggagctcagggccttctgtgcaaagctctgcactggctgtgtctccagccttttgtttactttttaaaaactcctttctaatctgaatacttaggaattcattgctaatggaattttagagcttgagcttctgtacccactatctttatgagaccccataagtagacatctaggattgctttacctcactgggacttaacattgttttaaggaaacacttgataaacactgggtggggttttaatgtttgtggttttaaaatgagacatttggaccagttatcaccatccagcaacctagtctacattagcagaccctatctctaaaaacaagtagttttaagtgctatatggtcatgcgtggcttttaacaatcagcaagttagaagacagactgctctccctgactccctgaaacattgtgacattatgctgcttggtgttctcattacacatctgttgacccacctgtgtgtggacacacatttgtgtcccggaagctttcaaaggttctgagcacagttgccttcatcagtctcagctggatactgagggacattggtgggagctgtggccttggtggttggatacaaaggccatgccagctcgggcactctgctttgtcctctcagatgcattcgccattcaagaccacacattggaaataggatgccctgccctgcactgtgacatctcaggaatgttccctgtcccttacttagctggcatgcagccagagtcctccatgctggctattctgggagctttggtgctgaccctaagtggttttgcttctctgtcacaccatatcagtgtttgctgacatgttacccaaagtgcatgaaactgtggcaacatctgtgtgtgggcgtggctgtggagagctaagggctcagatgagatgtgcgtcctgagagcagttcagtttctgcttgatgtttagttggtgcttggtgccctgagctacccagactcagtagagtgaggccttccctggcttccattctcagcatgatgctctgtaaaggcatggttcacttaacacttgatctccttgtttatcctcctagatggacaaagagctgcctccgggtctgtctttgtggtcacattaaagagatgttaaaaagctgttgctttggtgttgttctagataacagggcggggcggacagtctcctctccaggccttgattaggagatcctcagcggggaccgaatagtgaagtgggcatgtgactgactgagatggcttgtgcacagggaccattcctgggcagtagcatggtgaggtaatcagatgccgaccttgtaagagaggctgcactgtcttcatttgggccagtgtgtgtctgttggagttgtttctacctaagcctccaagagaaacagggactgtctgagtaaagtcaaactgactcagtgttagcgcagtgtgtagagctatagcatatgggtcacatgctggccttgtccggcagagcccttccatctatttttcggactagactgggcctgctgtacagggcttcagagaatggcagtggaatgagttatactgcagtggtcaggaaagcactgtaaattaggcataggtgggctggcaggggtcatcgatgtgtgtcaattgtacacattccttttcctctcaccccagtttccaccggctccctcgctcagcagtacgcacatcctaatgccaccctgcatccacaccctccacatcctcagccttcggccactcccaccggacagcaacaaagccagcatggtggaagtcatcctgcacccagtcctgttcaggtaagcagaggcctgacctgtgcgtgcacagctgctcccttgctcgcttgtccctgccactttacttacaagactccgtgtgatcagggccaccatcctcaagcagctgcgagctgttgtgggtacaggggaggtcttgaaaatgtgcgtcgaggtaggccattccctaagggtgaatgccagaaacagaagtgttaaaaggctcttagttaagtataaagcactctggaatttcattcttgaaaccaagccataatgctgccttctgttggcttcctcagtcacacgtgctaatgaggacagttaaggccttgtttgggcttgtaactgcccaactgagacttgggctcgagttccagaaaagaccctctggtcagggcatgcctgtgctctcccttctcacctccctggggtgtggtgggatgtgctggcctgttgctgtcactctatgatgctctgaccccagtggcttctcagtgaagaagtttcctattgctttacagcaccatcagcaccaggccgcccaggctcttcacctggccagtccacagcagcagtcggccatttatcacgcggggctggcaccaacaccaccttccatgacacctgcctctaatacacagtctccacagagcagtttcccagcagcaccacagacagtcttcaccatccatccttctcatgttcagccggcatacaccaccccaccccacatggcccacgtacctcaggtaaaccagcactagccaagtttttgtgaaggccacatagggagtggtggtggtcagataagcagcaaggagccagttgctccccaagccaggaaaccctgtgtgtggtgccatctgcctgtctgcccctttcctgcttagtacgtgatcttctggccctcagtgaatgttgctatgattttgtgatggatcagtgaaattgtgatttagcatttcccagctgagacctaaaactctgagtctggaatgcaccccagtcctttcctttctgtgtctgcttcgctccgtctctctagcttcaccactgtgtatatgtgtacacatacagacacctctacacacgcacatgtgagagcccgagagcagggtggcaggcagcggttctcagctctctgagggggactgcactgggcctgttagcttgagttagtcacaggaattctgagaagtgtcccagttgttttgcctggttacctctgctgttatcctgtactgtgcttcctgagctcgggccttggactatggtgcagtggaactgaagctccagagtagccccaggatcatctggagttttcttacccccagtgtaaggtctgaggttgaaaggtgtggttgctgatagagccagggcagcccagggccatggagaggccctctctatagctgttagcgtacggtggctgcatcagatgtttctgctatttttgatcatggttccctgaggtgggtctcacttagaagagttactgaatgattctatttcctgtctcagtgtgccagtgaggctctggcaaggtgtgagctaaagatgccgtgtagttgggtctcttgcagaaggctagcttgttactgtccttcccctagaatatactcctgttgattggctggcaacagtggggagggcagccagtttggtcagtgtgctttggtggagtgagacttaagagaatcagggtcctgtgagtgtccagcagaggttgtgaatttatgtgtaagatgggctcaccccaaacctcacttatgtgttttgtcagagagtaagaggctaatatagggaaagcagagagccacaggcctgtttggaggtgtgaaccagtgctttgctggtgtgatggtctagagcggtgcacaggatgggaggcaggaagcagcttcttcctgctcggcccactccctgcagagccgaggtcgagcttaccaaccccgttagctgacatcacctttctaacttaactttgttgccacttgatatggagcaccgggttgatccaacttcagatcactctctgacatcatctcagtggagccagtaactgcagcctctgctccatcagctaagcttttaaagggaggggcctaagtgccacttcaccctactttggggaacccatcatgactggggaagggcggaagaggagactcaggaagctgctgagggtgctggggaggctgcccccctgcaggcccttgtcaggctttctgacttgaaaggggcattgatatctttggccatgcgccatagctaagaaagtgcccttcccaacctaatagaggcctgcttttggtgaagaccttaccctgtgtggtaatctgagcagacatgttggggactaggaggctgtagccaacttccccatttatccctgcaggatctacctcacagtgacccaagaagtccatcttgccccttcttgagccctagtccaatgaaaggaatagttgacttgttgtttaagaaggagatgttgcctgtatgcgtaaaagagctctctgtttcaggctcatgtacagtcaggaatggttccttctcatccaactgcccatgcgccaatgatgcttatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccgagttctgctcgcagaggtagaatggcaggcaggaccagtgcttcaggctgcaaacctgactagcaaggcccgaccaagtgtgcacaggagggatcgtgacggtcagggagcatcagaatctgtgtgtgttctgctggtatcagggttggcttgagaagcagcagcctcattctgggtagctgatgcatgccgaggactcagttggccttcctggttatgtatgataggctggatagggcacgcgtgttccttcccgagtcctttataggctgatgtggggggtttatgcccatggccaagtttgattgtagcttggagaagaacactgatgagcacgtgctgattgcggactggtttgagtgtagttttagccccagcctgtgcctggacacaggacacccatgatgtctcgtactggatggctactgtgacgacacctgtcttccctgtgacttggaaagcagtggtgcttggctagcattagtgggagggggagtgaaggcctgtgctccacaagcagcaagtccaggacttgtatctgaagtggttttacgtctgactggtttgtttctcctcacctccccttccctccctccccaaccccaccttggctgcagctgggggagagagggcagcattaaacctctggccttactcagctagcacaagagcagttgacagtcacgtgctgcagacagacactaggctggtgggcagcagtcctgtgttgtttaaatagccacttttcttttttacagtacaagcccaccaccaacagcagttgtaagtctgccctggaggaaccgaaaggccaaatcccctcctcccttctactgcttctgccaactggaagcacagaaaactagaacttcatttattttgtttttttttttaaaaaagatacactgatttaacatcggtaggaatgctaacagttcacttgcagtggaggatgttctggaccgagtagaggcatgtagggacttgtggctgttccataactccatgtgctgttgcagggtcctcaagtacccagctctgcttgctgaaactggaagttatttattttttaatggcccttgagagtcatgaacacatcagctagcaacagaagtaacaagagtgattcttgctgctattaccgctttaaaaaaaaaaaaatcaagacttggaacgcccttttactaaacttgacagaagttcagtaaattcttaccgccaaactgacggattattatttataaatcaagtttgatgaggcgatcactgtctacagtgattcaacttttaagttaagggaaaacttttactttgtagataatataaaataaaaactaaaaaaaaattaaaaaataaaaaaagttttaaaaactgatacccagttagtgtgtgtttgtgttgactcctgctgctgtgggaggcagaccccagggaatggaggcaggccgggtgtgctctctgaagaggtgctgaccaaatgacttttcttcttcacctttagtatctagaaaaagtcaagactgagactccctctcgggtggagaggtgcagttggcttcagcagaaggaaggtgggcagcgttccaaagcccacatctgcaagcaggtgcagactctgtaagcttgcttttccttttctacagagccaaatgtggttgatctgagttatcccagttcaggcctgtgttaccagcagggggcagaagatccttctttaaaaaggaaacaaagaagcccaacgggcccagggtgtgtccttagtggctaagtgctgtctagtagagcggccagggatgcccgagaggggagatggaggaattgggtgaggccaggctgccagaagggagaggcaagtgggaggggtgtgtgtatggaagcagggatcgtggttgtaattctgaaaacctttttaattcacatacagcaatttgtacattgtaggaaaatttgcattattcaagaataagttactcgtacagtacataaaacaaagatttgccaaataccttctgctctaatgatagaagatgaagtcccctgatcctgtggtcacaatgctgcttattccagccacacgctggccattagacagatgtgtcctcgtcaggaggcagtgggggacagtttatcacttttatttgcaccaaggtaacatttaaacaagagactgagccctcagggaagaggtgaagccttaatttaggttaagagacttaggtaaaaatagtgttgtctggcccaagactgtaatggtcactattccttttttcctacaccatccagaaatgatcaaaggcagaagatttatacagataaagccatgtggatgctggtaaagacaaggcaggttagttgacctaactctttggtgctggtgcttgttagtctgagttgagtactcgggagaagggagcaggggttcaggactgttgagctgctctgtctctagtggccaactgacccatcctgccttgtgtggccagaagacactgctgagggtgggagtggggcctggctttgacacagggtatctggcccaggagttctcatacccggtacccgtctgtccccgtcagccaactggacctactttagcttaaagaaaaggtgctggcttagtgttgtcactctgtcacagagtcatgagacttttttaccttgttttctgatatcttggacattttttgaaacaaagctgtccacagtgagtgaatcccagcactaaggggccaaggtgctggcttacagcacctagcaagtctctctttgaaggcccaggagaaatgagtgccccaagtttgaagtgggtttagctcctggccaggtgcagggcacagccgtccacgcatcctgtgtggattagagccggcctggcccactggctgttactgctcacgtctctggttcatacctgatgtgcagtgaaggaaggcgctgtcctaagatgagcacaggtccacacctgtggtgggtgtcgaagctgaggtgcagctgcttccctcaccaaagcccacgcaggcttcccgagtgcaaggtgagcagagggg

SEQ ID NO: 5 - DNA, 115546 bp, Sus scrofa
ccagatgtacgtggccgcgggaagtcgatccagggttccaattctgatggtctaggcaaggaaagacaggagagcctgtctttgacacccagctgtcacagcgaaaacctactgtgtgccaggtgccggagatacaaaaaaaccatgggatgcttgtgttctaggtgctttatatgtagcaagacacagtctccgtcctgaagacactcgcaggtcactcgaggttgcatcaggtgggggcaaacacgcattctcccaacagtctgagaatgcagaacacttcggagattaggccggccctgcaggggaagacagacacgccctctccgaagggcagacccgcctcgagaagggcggacccgggcagggccggcagccgggccctcgcccgacccccgcgaaagcggcccagcgcagcgcccgctcctcacgtgtccctcccggccccggggccgcctcacgttctgcttccgtccgacccttccgacttccggtaaagagtccccatcccgcacctccgcgcccacccggcatcgccacgcggcacctctgtgtgcccggcccccgatgcgctcggcggccgcagctcctcggggccccgcagcggccatcgagcctcgtcgcttcgccgcggccaggtggcccgggaggcgctcgctcccgcggccggcgcggcggggcgggcggggcggcagcggcggggctccaagaccgtatccctccgccgcccctcccccgcccggccccggcccccctccctccgggcagcgctcacctccctccgcctcagactgttttggtagcaacggcaacggcggcggcgcggcccggcccggctcccggcggctcctcggtttcggcgggcctccccgccccttcgtcgtcctccttctccccctcgctcgcccgggcgcccccccggccgcgccaaccagcgcctcctcgctcggcgcccgcgcgtccccgccgcgctccggcgtctcctcggcgcgcccggctcccggctgtccccgcccggcgtgcgggccggtgtatgggcccctcaccatgtcgctgaagccccagcagcaacaacagcagcagcagcagcccacggccgccaatgcccgcaagcctggcggcagcggcggccttctcacgtcgcctgcagccgcgccgtcgccgacctcgtcctcagtctcgtcgtcctcagccgcggcttcctcctcctctacggtggcggcggctagcgcaggcggcgggcggccgggcctgggcaggtgggtgtcgcgccccagtcccctccgcttagggcctggaccagcctgggcctcgcgtcccctcccccgcggctctcaccgccgtccccgccccgtgaccggccgggcttgaggggggcggggtgggctgggggcccgcagtgggggtggggctcctgtctagatcctggagggttgggtgggggggcgccggggagacccctctgggaatgtcagtcagtgtcctgcctcccgcaccctccccaccccctcccccaaacggtcaagatggaaggactgggcagcctcgctctctccatttaagtgtttgggaggggttcacaggtctcagcaattgtcaacccatgttcaccttgtttaagcctcctccccacccatgcgggggggatgcttgggcagtgcccccacctccagcttaaatattagcgtggaaaggtcttaaggtttagatttctgtcttccgaaacttgccaactccctcattggggaataacgagggaggggggaaagttagggcagcgccccccccccgccccgcctgttaaaggggcagccacaggctcatctggaatcattagggtctgtccagtctgtttacccacctcccttcctgcccagagagagatcgaaggagcaggttgaggtgggtgggcagtgacaccccccgcacccttgccggtttaagtctaaaggcggcggcgggggctccagaactcctctggaatccttgggctctgtgcagtctcctgcagcgttccgccttcccccacctgaggaggggctggggagtgcccggcccgctcccggcctccctcctacccccgcaaggcctcgctggcgcgggtggtggcagatccgcattgctgttccgaggctgctgaggagaaggcgccttttaatactggtgggcgagggccggacccaggcgtgcgccagaagctcaggccggattggggacctggaggagaggtggtggtggcggcggggagcgggcacgctgtgtattttttcccaacccttgccccaattttcgaaatttcaagaggagagggattgcagttggggacacggtggggttctggaaggcagaaatgcgggtgtttactttgttgtctcccccgactttcccccatgacccaggtttatggtagagactgggggctcagtgttgtctcagctaaccgggtctggctctggagggtgtgtgtgcgggaagggaaggccagttgtgggtatgtggtggtggggggcggggtggttgtcagttcgtatttcacgaaccaagaaaatgcttagtgttccggtggggcagcaaatgtcaatagactccattccattgtggccagtgtccttaacttggggagtgccgccagagctcaccaagggcacgcaagtccatttcccctgtgcgcagagcccatccatgttgctggcattgccatgcctctcttaggccgggttggatggcaccttatgtgagggtcctccttaaatagatttcctgggctttagaaggtgagatagggggatttttatcatgcagagttttctttttgaaatcaagtctttttaacagtcattttcaaagacttcatttttagtagaagttatccgtctagatgaactggagctgattgtttaaggaattctgccttcattgtggggggcaattgggaacattgggttttttcttacttccagccttcctcccagtcctacagtttctcctttgaagcatctacaaatgctgcctaacaaaactagttcaaatgaagtgcttattttcccagctttgtccatgtaggattctgaaacctgttttcctttctcagtggcatctgtagttaaaaaaaaaaaaaaaatttaaatacaatttttatagaaaaggaagcactgtttttcttcttgggatcagatagaatctggcacatatattcaacttgttcaaataattaaaggttaaaatgagattttcagagtggtttgatcaaaaatatttgggatgtcttagtaccacagatttttttcctgttccttgagacttcacacaaacatttaaggttaatttagattcttgcttgctttaagttattttacctgaggcataaattatagaccttactctttttgataaatgaagttttgctaaatgtattgatggggtttatattgtgtgaattttgttcttgtacatctctttagataatgtacttggagaattcctttcaattttgaatcacttattgggttccttgtatatcagtgataatttttggagtttcttgccttaatgtttttgtgtatcaacagttaaaatacttttctgggaccaaaggtgaaggaagaaaatgcaccattgggtttgacatgtttagagtcaacaggatattcttaaaagtctagacatctgtgtttttcatttttatgtagttatagtgattgtgtatgctattttgtgttcagcttttttcttggaacactgtatcgtaaattttctttctgggtttctgcttaaccattctgttgtggggatttgggttttcacattttcgctgttatagataatggtacagtaaacgtttttatactactagcgttttgcttcagtctatttccttagagaaagttcccaggagaggctttagtaggtcaaagggcttcaagtttttatgacttgctagctcttatactcttcagaagatttgtgtttgtttccaaagcccagaaggtagctcttacagaatagtttctttgtagattgtcagacactttgggggatttttcaggtaaacagttgcatttactgtgaagtgtgtacataattaagtgcttttgttagttacttgtttgtctttgaatttgatttctctgaagatttaatgaaattatgtgtgtgtgggttgtttgaaaactgtaactgttaatactaatgttatatctattgtgctgatacttctgcagagtaagtagaggaatgacagttctgaggaacttttttaaactttttttgtttggttaatcttcctcattcatctaaaagtattttttactagctgctagcttatgatcatatgattttttggtaacttttttggtaatttcacagcactattgagaattatcactggttagctatatctcttcctgctgcacattaccttccctgtttaaaaaaaagtgtgtgtgtgtgtatagtaggtttacaatcctattaccatattcaagatcctaaataatatagtcttttttttttttttttttctttttgcaatttctggggcctctcccgtggcatatggaggttcccaggctaggggtctaatcagagctgtagccaccagcctacgccagagccacagcaaggcgggatcccagccacgtctgcaaacctacatcacagctcacggcaatgccggatccttaacctactgggcaaggccagggatcgaacccgcaacctcatggttcctagttggattcattaaccatttagccacgatgggagctccctaaataatatagtcttagaatttctttggatacaggataaagtgtgaaaaaaacttttttaataattttcagcttagtacttttactgcttctttctcttaaggcatcacaacttagaaattatgctgcagctcagtgtaattgttgttcatcatgtttccatttatgtattggtgaggtgtttgtctctaaattaaatatcttacagaagagcctaaaaagatctatattcattcaacacttaagtttattgaaaatctatgtagaagggaggtgtagattcttgggactttatcagtaaataaaagaaaagatagttgccctttttttgtttcattccaatatgatgaaccagacggtaaacaagagacattaaattagcaaactgcatatattagataaaagctataggattagaggagagcagaataagggcatgatatgggagtgtgggggaagggaatgggttgtagttttaaatgggtttgggaggtctcattgaggtaacatttgagcaaagctttaaaggtgaggtagttagccatttgctttttatctaattaatcatttggccccatgtgtaatttatttaaactctatcctttgttaattcattctgttaatgtggatattgataatcaaatttgaaattgggccaaaaaattattgacatttaggtcattggaggtaaaatgtagatggctgttaaaataggtacatttttggttttgtctgtctgtcttccttcctttcttcctttcttttcctttctttcccacgcttgtggcatgcagaagttccatggagccaccagggaactccacatttttggttttctcttgggcttttttactttacctaatcagttaatttttcattccaagtacctagagaaaatacagttaaggtaaacctataacagattgcttatctttaacagttaaaagtaagcctatagttgcttgaagattttgcattctgaaaagtcagcacatttcatggtatcagtcatagtgttccttttttggttaaatgtaaacttgtatttctctaattagacagttatactcttacacaggggatgttaactcatatcatagctatttaatagccatatgtttcaacttaaaggaggatttgattttttttctttttgtaaatagctacagctgtattagaacttattttcaccactacagtatttttaaaccttcaaaaggactttaaatttttttaaggttattttttccctagaattgtaattatctgttttggctagatagtatttttggtattgttttaaagatttaagcttgaacaaaaccttgtcttagtatccacttcaaatgattgtgataatctaaacgaagatatagtttattaggcctacctgtgtctgtgtttttttaattgaaagtagtggctttttttttttttttttaaagcatattgggtcatctatgactgttatcataacacgattttaagaggtccatacagtggtcttttttttttttttttttttttttttttcctcctgctttgctttttagggctgcacccatggcatatgaaagttcccagggtaggggtccaatcagagctacacctgccagccacagccacagcaatgccagatccaagctgtgtctttgacccacactaccgctcacagcaatgccagatccttaacccactgagccaggctagtgatggaacccgcatcctcatggatcctagttgggtttgttaaccactaagccacaaagggaactcctacagtggtcttttttagcaagagttattaaaagtaattctgttgtggtgcaggggattaaggatccgatgttgttgctgctgtgggatgggtttgattcctggcccaggaacttcacatgccatgggtgcacccccccaaataaatccagaatttgaaatataggtacttttgacccttaatctctgctaacattacttatgactggaaatagtttggcctacatcttaatgtgttttttgatatccttaaagtatacttttctactcaaaaatagtttcatataagatttcctgttgtggctcagcaggttaataaccgaacatagtgttcctgaggatgtgggtttgatccctggcctcactcagtgggttaaggatccagtgttgtcacaagctgctgcttaagttatggatctggcgtggctgtggctgtgcctggcagctgcagctaacgtttgaccgctagcctggaaacttccatgtgctgcaggtgcagccttaaaaagaaaaaaaaagtttcatgtatgtccataaatatggaatttagtgctttgggctgtatggacatatatagaatgtgtccacactgcttatagtgttaagagataagagatacttaagtcagtgtccagattcttaaaattaataagctgagaaaggtttttatgcaattattacctcgtttatatctgacaattgtctcataagttgaaaaacagtaagttttaagtacttattttagatgagtgcagagaattaaaaaacaaactcctttaaaattaaaatctaggagttcccctcgtggggcagtggttaatgaatccgactaggaaccatgaggttttgggttcaatccctggccttgctcagtggattaaggatccggtgttgccgtgacctgtggtgtatatcgaagacgtggcttgattcctgcattgctgtggctctggtgtaggccagcagctacagctccaattagactcctagcatgggaacctccatatgctgcaggagtggccctagaaaagactaaaataaaataaattaaaatctaccagaagttcccatttggttcagccggtggcaaaccagctagtatccatgaggaggatgcgtgttcaatccctggtctacctttggtgggttaatgatcaagcatggctgtggctggcagctgcagctcagattggactcctagcctgggaagttccaaatgctgtaggtatggccctaaaaaagaccaaaaaaaaccaactacagtcttttcttcgagatagaaaactttggtgtaccttttttcagactttttagaaacacatatatgttaaacaaaatggagtcatatggtacatattgttttggattcagaagtatatattttaaaatatttatttttcccctaaaattgtagaattttagacagaaaatcttaccttaaagtagaaggaaaaaaaccctaagctttgagagtagagggagagttcccagcgtggcccagcggttaacgaatctgactggcatccacaaggattcaggttcaatccctgaccttgttcagtgggttaaggatctgccttgaactgtggtataggctgcagacagggctcagatcctacgttgctgtggctgtgttgtaggccggcagccacagttccgattcgacccctgggaacctccatatgccgagagtgtggccataaaaaaaaaaaaagtagagggaacttgcccaaagcaacatatttgtagaattatgttacatccctcttttaaataaatgcagatataggtataaacaagatcatgttgtatgttttattgtattgttttcttttttcctttcaaggctgcacatgcagcatatggaggtcctgaggctaggggtcacatcagagctgcagctgcaggcctatgccacagccacagcaacactggatccttaacccaccgagcaaggccagcgattgaatctacatctttacagggactatgtcgggttcttaacccactgagccacagtgggagcttccatgctgtgtatttttttttttttttttttttttttttttttttttttttgtctttttgtcttttttttgctatttctttgggccgctccctcggcatatggaggttcccaggctaggggtcgaatcagtgctgtagccaccagcctacaccagagccacagcaacacgggatccgagccgcgtctgcaacctacaccacagctcacgacaacgccggatcgttaacccactgagcaagggcagggaccgaacccgcaatctcatggttcctagtcggattcgttaaccactgcgccacgacgggaactcctttttttttttttttttttttttgtttttgttttttttttttttttgtctttttttgttgttgttgttgttgctatttcttgggccgctcctgcggcatatggaggttcccaggctaggggtcgaatcggagctgtagccaccagcctacgccagagccacagcaacgcaagatccgagccgcgtctgcaacctacaccacagctcacggcaacgccggatcgttaacccactgagcaagggcagggaccgaacccacaacctcatggttcctagtcggattcgttaaccactgcgccacgacgggaactcccatgctgtgtattttaatacacaaccacagacagtccttgtccttcagtctgtcttttgtacccttgagtttggctcagtaaagtagaaggtctaagtctttatttttttttcaaatatagtgtgaaatcttatacttaagtgttaagtctttttttttttacctttttttggctgtgtctggtgtgtggaagttcctgggatgggttgttgaacccaaactatggcagtgacgcaagctgctatagtgacaacaccggatccttaacctgctgcaccacaagggaactctggttttgatttttgggtttttttggtcatttttagttgccccatggcatatggagctctggggccagggatcagatcagaatcacagtcacagcctaagctgcagctggcggcaacagtggatccctctgctggatttcccagcagctcccaagactccgtccatctcattgtgccacagtgggagctcccagttttgttatttttaatggtttagattgttacagatctgggctgtttatttttattcattacttttgggggtcgcacttgaggcctgtcgagcttcgtgggccaggattgaactaacactgcagttgtgacctacgccatagctgtggcaacgccatatccttaacctgaagatcttgggatcttcctatttatgaaaatttgccacagttattaaccttgagttttatttgctgaaaattatttgtagttgtattcatgtgaaaaattgaaattctctttgaaataactctcatgtagatggcttatgcttaagccttgaaatacaatcgagtggctataaaatagcaattttggagttcccgtcgtggcgcagtggttaacgaatccgactaggaaccatgaggttttgggttcggtccctgcccttgctcagtgggttaacgatccggcgttgccgtgagctgtggtgtaggttgcagacgcggctcagatcctgcgttgctgtgcctctggcgtaggccggtggctacagctctgattcaacccctagcctgggaacctccatatgccgcgggagcggcccaagaaatagcaacagcaacaacaacaacaaaagacaaaaagacaaaaaagacaaaaaaaaaaaaatagcaatttcatgccatgattaatagctagctgcatattgggaactaggtaaaatggcatgctataatggagtctttgtaattcttagcagtttgtggtatgtggcttatttttattaagtgtatcagaactttagaatgtcctcttgaaactattaccttgagaggctttagtgtttgtgttgtcaatgtctttttttttttttttttttttgctttttagggccatacccgtggcatctggaagttccccagactaggggttgaattggagctgccagctgcctacctgtagcacagccacagccacaagggatctgagccacatctgccacctacaccacagctcatggcaacaccagctccttaacccactgagggaggccagggattgatgttcatggatgctggttgggtttgttacctctgagcacaacgggaaccccaatgtcagatttttgttgttgctgctgttgttttgtttttatggctgcgcctttggcatgtggaaatttctgggccagggattgaatccaagccacagctacaacccatgcctctgcagcaactagagccactgcagttggattctacccaatgtgccacagtgggaactcccaacatcaaatatttttgatcatattgctttttataagttgcatcctaaaaaatattgttagtagtctttgtaagtagtcgagtaatcttgattatagtttgttgtaaaaaaaggaaaagctggttttgaaccaaatgatgcattcttcctttggggctcataaaaagcattttttttgtgaaccttgtatagttaactattttcactcctgaagcatacttgaaaatcaagtagataaaaaaaaaatttaaggtctttacattgacgcttgtgctgattatagaaaggggagtgcttcagggcttcttttcttctcactttatacatgattctgtagagcttgctcttttgatttacagattgcaagtaagaaagataaaacttttaggggccaacatattggtagcaataagaagtaataatagtgtgatagaaagttgagatgcgaaaattataaaaaacagatacacgagcttaaaagtttaccattgtgggaggtgttgtgtttttgtcttttgtccttttagggctgtacctgctccatatggaggttgaatcagagctgtagccgccggcctacaccacagccacagcaacgccagatctgagccgagtctgcacctacactaaagctcagggcaacgccggatcctaacccacttagtgagacccgcaacctcatggttcctagtcagattcgtttctgctgcgctgtgatgggcactcccattgtgggagttttgactgtaagttcatagctccatgccttagtagaccccagagacaatactattttatgacataatataattaattgatatgttcataatggtaatgtaagacaaggttaaattatttttcatgtctttcaaagaaatgtatttcaagtggtaggtcatgaccccttagtagatttgtaaaatcactttagtgggtcatgacaagctttttttttttttttttttgtctttttgtctttttgttatttctttgggctgctcccgcggcatatggaggttcccaggctaggggtcgaatcggagccgcagccactggcctacaccagagccacagcaactcgggatctgagccgcctctgcaacctacaccacagctcacagcaacgccagatcattaacccactgagcaaaggcagggaccgaaccctcaacgtcatggttcctagttggattcgttaaccactgcgccacgacgggaactccttgacaagcatttttttaaaaaatgaaaaaaagagtgaaagatattacaatgtattgtgttttaaggaacttgcttttcgcttagtttatgtatactgtgttgcaatttaagctgtagtttttcattgatgtaatcaaaatcactgatttagaggcaccaagattcagtaaaaggattgaggaagagttttgcagttatatctacactagggttgctagatttaggaagtaaaaaatagaggatgcccacttaaacttgaatttctaataaacagtgactaattttttcgtataaataggtcccaaattgcaattatttaatttatttgaaattcaaatttaattgggcattctttatctagtaaccccagtctaggctagaattggggttcacctcttggtgactaaaatttaagctctgttccttttttttttttgctcatagttgtctcccagtctcctggaccagtgcttggcacttactaagtgcacagatgtttcagtgaatgaatgggcacatcacttttaggctcagtttctgtacttattaaaaggtgaaaagaggagttcttgttgtagtgcagtggttaacgaatccgactaggcaccatgaggttgcgggttcgattcctgcccttgctcagtgggttaaggatccggtgtttgccatgagctatggtgtaagttgcagatgtggctcggatcctttgttgctatggctctggtgtaggctagtggttacagctctgattagacccctagcctgggaacctccatatgccgaagcagtggccctaaaaaaggcaaaataaataaataaataaataagtaagtaaaaggggaaaagaattcctttcttaaaaagtaaaatagggaggagttcccatcctggctcagtggttaatgaatccgactaggaaccatgaggttacaggtttgatccctggccttgctcagtgggttaaggagccagcattgccctgagctgtggtgtaggttgcagacgcagctgggaccccgcgttgctgtggctctggcataggcttggcggctacagctccaattagacccctagcctgggaacctccatatgctgcaggtgcagccctagaaaaggcaaaaagacaaaaaaaagggggggggagttcctgttgtgtctcagtggaaatgaacccgacttgtatccatcaggatgcaggtttgatccctggccttgctcagtgggttaaggatccagcattgccatgaactgtggtgtaggccacagacgtggctcggatcccaagttgctgtgacagtgtgcgtggtagctgcagtttttttttttttttttgtctttttttttttttttttttttttttagctatttcttgggctgctcctgtggcatatggaggttcccaggctaggggtccaatcggagttgtagccactggcctaccccagagccacagcaactcgggatccgagccccgtctgcaacctacaccacagctcacggcaacgccggatcgttaacccactgagcaagggcagggaccgaacccgcaacctcatggttcctagtcagattcgttaaccactgtaccacgatgggaactcccacagctgcagttttgatgcagcccctagcctgggaacttccgtatgtcacaggcgcggccctaaaaagactgggggaaaaaagtgagatactagagttcttttgtgacgcagcacattaaggatctgccattgtcactgcaacagcttgggtggctgcggtggcgtggatttgatccctggcccaggaacttccatatgccatgggcatggcaaaaaaaacccacaaaaagtcccaaaaggtgagatactaaattttattacatttttttcttggcacatagtaagttctcagtatttagatgtatacaaatttggagttggaagtggctctggttcggttcttattctctttacagatgaggaaaccatgaccacgaagattatttgtgccaaggttctctcattattggctgcctagctggctttagaatctctttctcttttctttatattgtagcatatttcttaaaaacttgtttttaggaattcccatcgtggcgcagcggaaacaaatctgactaggaaccagaggttgtgggttcgatccctgggctccctcaatgggttaaggatccggcattgtggcgagctgtggtgtaggttgcagacatggctcagatctgatgttgctgtggctctggcgtaggctggcagcaacagctctgattagatccctagcctgggaacctccatgtgccacaggtgcggccctaaagaaaagacaaacagaaacaacaaaacttgttttctaaatttgctattcacttagaaatctgagacccacttgtccagaaaaaaatttctaagtgttccaattagcaaagactactattttttgggggggggcggttctagggctactcccacagcatatggaggttcccaggctaggggtctaataggagctgcagccaccagcctaagccagagccacagcagtgcaggatctgagctgcatcttcgacctacaccacagctcacggcaacactggatccttaacccactgaatgaggccagggatcgagcttgcaacctcatggttcctagttggatttgttaaccactgagccacaacaggaactccctctactattttttgtttattgtcatatttaagtggaagagtgtctttttagtccttttgatttaggaactagaatccaaaatgaagttcctcagtttctaccaggcattccttttctctgtgactattccttcctgttccttaacctagctggcaagtaggtttcactttgtatgataattatagttagttggtgtgttgtttggaggattctgagatttggtttggctttagagaagagatgtaggtagagaaggcttagggtgagtctttgtatcatgggcaccagtgggtatttgttgactatagtttagcaaactttcaaattgatggtcttcttgtccagatactttctatattctccatagccgtaagaatcttctccaaacatctttcactgtttaccagtactattaagaaaacttttttttttcttggctatgcttgtggcttgtggaagttcccaggtcaaggatcgaacccatgccatagtagtgacccaggctgctgtagtgacaattctaggtccttaacctgctgtgccacaaggaagctcctcttaagaggtttgcatttctagctgaatcagatctagactattcagactgttaagcccccaaggactgtacacactgaattcttcagaataaattatgtcaatctagtcattctcttaagcaaagttttttgggggtttttgggtcttttttagggccgcacccatggcatatgtaagttctcagactaggagtttgaatcagagccacagccgctggcctgcaccacagcaacagcaacaccggatttgagctgcatctgcaacctgcaccacaggtcaaggcaatgtcagatctttaacccactgagcaaggccagagatcaaacctgcgtcctcatggattctagtcagaatcgtttccacagagccacgacggaaactccaagcataggtttttttcgagggtttggcacagatcctctcttgcacagtgtctcaccatatttaccctaggaaaatgggattcctcctgtagcttttggcaggtatcattcctgcagcgttcagtggagagtgtcttgtacttaagtgcagcagtttctccacttacaacctttctcttttgaatgaactctaagagcagagctacaccacagaaaaaaaaggggtggttaatcccaccaacaaatgacctttttaaaaataatttatttttgggggggttatgattattttgcagtcagttattcctgtcatttaaaaattctctgtatgattactgtatttgagcttagtttattgttgttaaagctatcattttcaacaagtccagcagcagtgagtattgatagtgcccatcagaagaaaaaacatttaattttggtagaattgagaggttttaaaaatttaaagtcacagggacaggacaaattattctgaaggacagagagcaaaaagcaccatgtttattaatcagtaataatcagtaaaagataaattttattggagtagagttgtcttagaaagttgtattacagagttcctgctgtggcataatggggttggcgctgtccttgcagcgccagcacacgggtttgatccctggcccagcccagtggtgaaaggatccagcattgccgcagtgacatagcttgcaactgtagctcagatccgatccctcgtcccagaactccatatgccccggtgcgccccccccaaaaaagttttattagtttcaggtgtacagcaaagtaaatcagttacgtgtgtgtgtgtgtgtattccttttatacacacatacacatatatatactccttttcagattcttttcccatataaggtatcacacagtattgtgtagattaccctgtggtataccataggtccttgttgaccatctactgtgtttttgtcttttaaagtccacacccatggcatttggaagtttccaggtaggggcgaatcagagctacagctgccagcctttgccacagacacagcaatgcaggatccaagctgcacctgtgacctacaccacagcttatggcaactccggatccttaacccactgaacgaggccaggggtcgtacccacgtcctcatgaatactagtcagattcatttccactgtgcccttttagtgtacagtttttgagtttcgacaaacatacagtcatgtagccactaccacaaacatagtatcatcccataaattttcattgtgctctttttcagtcggcccccctcctccaaggggacagtcactgatctgtttcctgatattatagtcttgtcttttctagaatgtcatatacatggtgtgatatagtatacagtcttttgtgattggtttctctcatgtaacattatgctttgagattcattcatgttactgcatgcagtgtttcttccttttcctttctgggtagtagtctgttgaatgcatgtacagtgtttatgaagtgatggacttttaaactcttagcagtttttggctattatgaataaagttgttatgagtatatatgtacaggttttgggtggcaataacaatttcatttctcttggttaagtacatagaaatggaattgctaacttgtatggcatttatttatttatttatttattttgtctttttgccatttcttgagcctctcctgtggcatatggaggttcccaggctagcggtctaatctgagctgtagccaccgtcctatgccagagccacagcaacgtgggacccgagccacgccagcaacccacaccacagctcacagcaatgccggatccttaacccgctgagcaaagccagggatcgaacccacaacctcatggttcctagtcggattccttaaccactgagccacgatgggaactcctatatttatttaattttaaaagaaattgccaaactgtttgctaaagtgactataccactgtgtatccctctcagcaatgtgtgagatttctatttgctctgatttcttggcaacacttagtatgctagtgtgttctgttttgtttttctttgctttttagggccgcacccatggcacatggaagttctcaggccaggggtcagaattagagctacagctgccggcctatgccacagccacagcaatgggggatccaagctgcttctgtgacctatacctagctcatggcagtgccaggtttctgacccactgagtgaggcaagggatcgaacctgtatcctaatggatactagtggattcatttctgctatgtcacaatgggaactctctgatagtgaacatttttttgtgtactcatttgccatttgtttatcacctttggtgacaagacactactttcaatcttacttgtttgaaagtaaaggagcttctgaatttgcattgcctgctttctagatttagaacatcttgaggatggagtgccttgtaccactttgtatacttagtggtaaattatttgttgattatatgagtactggtttcatttttttttttttttttaactttttagggccacacctgtagcatatggaggttctcaggctagtggttgaatcagagctgtagctgctggcctgtgccacagctacagcaacactggatctgagctgcatctgcaacctacaccacagctcatggcaatgccagatcattaacccaccgagcaaggccagggattgaacctgcatccttgtggatactagtccagattagtttctgctgagccatgatgggagttccagcgctggtttcattattaagcagatggatttattctgccaaggaagagttttcatctcaaatggaacatagcatttattttatagtcatactatagttaatctttttcagtaccttctgtttgccaggctctgggattatagtggtaaacaagccagatgagatcactcccttcctgaagcttacatactggaacagcagacaaggcagaaagttcaaaccttgctatcccatgatatgtttgagttgctaatgcttagcatgcttccatcttataaaatattggaaagaagacttttagataaagggggaagaaagctttttgcttttatcttaggccccttatgagttgtccagtaggttgctaggggtattaatcctttcagtgcttttgggataggcactggctagtcatagaaatcagtgtgtttgaggagcctcctggtctaagcttgtgaaagctgattagggtcatgactgaaagggagaaggaaaacatttattgagtggatctaccatgagcttcctattctgctagggcacatacatacattatatacatgcccacacatttttttttttcatttgattatcacaaaatcctattagataatctgttgccctgtctcattttacccatgaggaagcaaaggtccagagaggctaggtgatctgtttaactttactcagctagaaagaggcagagatggaatgacttactattgttgtatataagatctttgaaaaagtatatgcaaatgagagtaggagaaatctggtgatggatttaaggaatgttacaattagtttcttattttaattgaccaagaacttgagtgttagcttcactgggtgagggaatttatgtcagcaggttccttaagggtgacagttgtaaaaggaatttgcatttgtgacaggtaaaggaatttagttagtcatggtctgtaaatattataggaagtctgcatatttttaacccaatgtaaaaggttagaaaataaatgagaattcctatttattgtaacacctgtttttcctgtgtaaaacacttgaggaaaaaaaaactaccgtttctgagccaagtggagatagtagccattttcctgaaaagttcagatatgtatgatgtgaaaacagtttatagagagctttctatttatataatgatagttagcatttactttgtgcctgttaggtttcaggaactgtgccaattacattacttatatatcctttaattcttagaactctgcctgtcaggttggtagtggcatatccattttacagacgaggaaatggtggctcatagaaattgaggaacttacccaaggtcaaagagctaggaagtgatgaagctgagattctaaccctgtaagacttcagagcttttgcttttaatggctgtgcttcactgcttctagtttagcttttgacaaaagcagataaaaatcaatgaagaaaacaattcagtcattgttagacataaaatagcttcagttagccaaatttagtcttggcagttgtatttataatgctggatccaaaagcttatgatttttattttaaaatttggaaacagtgttataaattgtgattagttttctgcacttagcagtcagttgttacctgtaattaatttgaactaaatatcactgtactatatcataggataagaaggcatttttggcttgatctaagaaaccaaaagccacttaatgtttctgtagggaaaataaagtgctaaaacccacttctccactttccctgtcttggtcatgttgaaggcttcatagccctggggcttgaggaacacactgaatcaacacacttagtaaaacttcaacaggacacattagtcctccaaaaagaagagattaaataggtaaagaaatgattcctgttctctgaggctttagggaagttcctggctatgctgcaattatttatacgggccaaataatcatgttaggcaatcacgccttttattttttttccatttttggctcccctgaggcatctggaactctggggctggggatcagatcctagccgaagttgcaacctaagcagcagctgcggcaacaccagatccttaacctactgtgccaggcttgagatagaccctttgttcccagggctcccaagacgccacctatcccattgtgccacaacagtaactccacattttactcttaattactgcaacaaattaactttgtccacccaattttacctgaccctcttttttttgttttgttttttgtttttttcttttttggccacacctgcagcattcgaagttcttaggccagggatcaaacccaagcgacagtagctttttgacaatgctggattcttaacctactcagccacaagagaattcctgtctagccttccttttgctattagattgaaactttacttttgttgggtcacccttctgcttgaaaaccatccttttctcaagcctgaagttctctttaaccttcaaggctttccataatctaaccaaggccacatacagtcttttttttttttttttttttgcatattctatttttaaaaactttttaaatgaaaaaaacgtttttagctctgggctgtataaaagcagactgcaggcccatgggcatttgccaaaccattttatcattctggttgtttttcattcactctttaaaacatgacctccatttaaatcagcatggtctccttttctcattgcctctaaaggtagcaagttcatccttgattcccttttggcttttccatcattattcttcttttccacatcctcatatttatcctctaagatttagcttaagtcattcatgaaacgaattctcatttatttttctgtttattaactcctgtagaactcagcttgtcctatatgttagctttcttatttaagaacatgttccatgtttttttccttggtaacttgctataaactacaagaataaaacacatttcccctcaaactgttttctagagaatgcctaaagttactattgctcctcccctagatctgaattttatagttcacctctcatttgagatcatcatgactcatcctttatattttacacaggagcaggaactttaaatgacttgtccagaacacagtttatttagcaccttaggccttttctttctgacttctagcaggttatttcacttttgcttgagtttctctgtgaaataggaatgatgaggattaaatgaattatgtatgtgaagtgtttaaatcactgcctgtcatgtgatacactgctcaataactttcagctgttagagttctcctgctgtgaaacattaagggaacttccatatacagtgggtgtggccaaaaaattttaagaaactttgagctgttattagcatgttattagcatgtttgaaaatcagtgaacaagttaagacagaaaactgtgtgttgatgggtttggggaagtgttctatttagtagagacagttaagcattttgttgagtttatatgtatactgatgattaattcagtagaagtttgaagctgtcagactgggatagttaaaagatgagtaaaacatctctgcatccaagttacacagagtgtgtagtggggaaaggcagccatgcaggtggtgtgaactggtagcactgaggagtgagtaaatgactgcttttggtggctggtgaagaaaaatctttaaatattgatgagcgttgaggtgaatcttaagaaatgatgataagcagtttccaatgaggccatggaagggaggagaaagccaggcagggaaaagttcgctaaagtacagagatgcctataaacatggttgtgggttgaaaaatttggtttacagtgtggtgaaagaattggagggaataagtactgaaagcagagagatagatttggaagcccttatagttagagaagaaagtgctcttgaaataagtgctaattagaaattttttattagaagatttcagcataaaaatagaacagtttaatgagccttatgtatcactcagttttagcagttattagtaaatggtttatcttgtttctcctatattcccccttccccattatcacttgtagtcttttgaagaggattaaagttgttttgaggccctgggaaagattagtgactaattggtaaaatcgttgggagagagacttgaattcaccacaaagaaacactctgtgcactagtcaagaggggagggatgctttggagggtagatagcacctgctcttggagaagctcaaagagagaactggaactgcactgttgagtatgatggccaccgtccaggtatggctatttacatttagaataagttaattgaaactttaaaaaaataaataaataaaaaataaaaaaggaattcctgttatggctcagtggttaacgaacccaactagcatctacgaggatgcaggtttgatccctggcctcactcagtgtattaaggatccagtgttgccgtgagctgtggtataggttgcagacatggctctgatcccaagttgctgtggctgtggtgtaggccggtggctatagctctgattggactcctagcctgggaacctccatatgccactggtgtggtcctaaaaagacccaaaaaaaaaaaaaaaaaaaatcagttcctcagtcacactagccatatttaaaatgctcagctgccacatgtgcctggtggccaccatattaggcagcatggatatagaactttttttggggggaggggcacacctgtggcacatggaggttcccaggctaggggttgaatcgaaggtgcagctgccagcctacaccacagccacagcaatgcaggatccaaaccatgtctatgacctacaccacagctcatggcaacgccagattgctgacccactgagcgaggccagggattgaactgaatcctcatggatcctagttggatttgttaaccactgagccacgaagggaactctgaactttttttttttaaatcattacagaaagttctcttggacatgctggacttgagccctgggattcctttttatctgaattgtgtggagtttttggtgtgtctaggtcatacctaattgtgcatagctttatggccaaactctatctcttcctccaaggcatgtggaagttcccaggctaggggtccaatcagagctgtagccactggcctacgccagagcaacaagggatctgaaccaagtcttcgacctacaccacagctcacagcaacgctggatccttaccccaataattgaggccagagatcgaacccaccacctcatggttcctagtcggattcatttctgctgcgctacaatggaactctagcaatgctatattcttaacccactgtaccaggctggggatcagtacagcactcccaagacactgccaatcctgttgcaccatagtgggaacttttaagtaaaagttcatttgaagagttttttggttttgttttataattctagtgtatgctgtaatatgaggaaagtaaatgcattagctaataattattaagcagttcataatgtgccagtcattattcttaagctaagctgtctatatgtgatgtcatttaattttcattttcttatgagaaggtactttttttttgagtacttactactgtttttatcatacattctgtagatgttgaaattaagacacaaagagctgaagtcatgaggttaaggccccagagctggaaagtagtaaggtcggaatgtgaacctaagcagtttgcagaactgaaatagttcttttggagatggttcttaaaacattgattctagatgattacatgattggattaattccccagttgtgtcaatttagagttgtcagccctcctcagtttactatgggttgtcacagccctccctactgctactttgtttgactcatcttttcagtgaggaagtagttattcaataagtattggatatataatttccctttctaataaaactgaactggaaagaacaaaatgactcatctgagttaactgtaagagctggagttagatttctagttcttagttaactgtcctttctcttttttttgttttttagggccgcacttgtggcatatggaagttcccaggctaggtgtcagagctgcagctgtaggcctacaccacagtccagcaatttgacctatgctgcagctcacagcagtaccggatctttaatccactgagtgatctttaatccgctgaccaggggcagggatcaaacttgtgtcctcatgaatactggttggattcatttctgctgagccacagtgggaactctgattgtcctttctcttgactgctgtagtttttctataggaagaaattgaattggtcagtactcatcataattcatataaactatactatatacttaatttattcaacaatttagagtactgactgtatgccaggctctgttctttagccctgggcacacagcggtgaatgagacagaagtgtttgccctaatggaatatgtcttttggaggtggtagatgtatagagacagaaataaagtagatggacatataataatatttcaattagtaagtattatgcggtactaaatatgtgttacttaactgctaaaacagtgatacaataatggttgaggagctacttttgatggcttagtcagggtaggcctctgaggagttgacatgatctaaataacaacaggtagtcagccatgtgaatattgggggaagaacattattacaattttattggagggggtttcaggaatgtagtattcttagtatgccaaagaatattagttatatcgaaacagttagtctggttttagaaatttgggtcaacgaagtattttaattgggtgcatctatcacccaagcttgttcgaagagctgtagaaaatagtgaatgatttctatagttacagttttgcaaaatggtgatgagtgaacagaatggtgaaaaatgaagtaaaaaattaaaagttctgtaattacatggtgtggtggcagtaccagcagaaattgcatgtttgtctcttgccaaactttgaaacaataatggaagggaattttattcttaggttatttaatatgttttactaatcagtgctcttggatttttttttttttttttttttggtctttttaggacctcatttgtggcatatggagattcttgggctaggggtcaaattggagctgcaggtacaggcatatgccacagcaacaatagatctgagctacatctgttatttgtgcggcagctttcagatctttaacccactaagtgaggccagggatcagaatgcagcctcctggatactgtgtcaggttcttaacccactgagccacgagaatccagccacaaggaactcctcagattgttgatgtatttttttccaatttgataattcttggtgttcctgctgtggtgtagctggattggtagcatttttgcagtgcctggatgcaggttcaatccccagcctggcacagtgggtttaagtggtctggtgttgcttctgcagttcagatctgatctctggtctggtaactatgtggcatggggcggacaaaaaaagaaagaaagaaagaattccggtggtgagagagacaggtaaaatatacatatgaaaatatgcttttaatttccttccctagtcataacttctgatgtataagctggttgaaggcaaggctgtattcatcttgttttctcagtaaatatttattatttatttatttattttaagggccacacctggggtatttggaggttctcagaccagaggctgaatcagaacagcagctactggcctccaccacagctagagcaacaccaaatccaggtcacatatgtgactggtaccgaaacttgtagcagtgctggatccttaatccactgaatgaggccggggtggaacctgcattcttttggacactaggttgggttcttaacctgctgtaccatagcaggaattccaatatttgttaaaggtaaaccttagaaaagctgcagttttttttttagggccacgtgtgtggcatattgaagttaccaggctagggactgaattggagctacaactgctggcctgtgccacagcaacgtgggatccgagctgggtcttcgacctacaccacagctcacagcaacgccagatccttaacccactgaacgaaaccatatatccgaacccacatcttcatggatactacttggattcattactgctgagccataatgggaattccaaaaagaaagctgcaattttgagggtttcttctgtgccagactctttaaaatgattttacaattttatatgccgtggatgtggccctaaaacgacaaaaagagcaaaaagaaaaaaggagttcctgtcgtggcacattggaaatgaatcagactaggaaccatgagggttgcgggtttgatccctggccttgctcggtgggttaaggatctggtgttgctgtgagctgtggtgtatgtcgcagactcggctcagatctggtgttgctatggcgtaggctggcagctgtagctccgattagactcctagcctgggaacctccatatgccactggtgtggccttaaaaaggacaaaaaaaattttttttttttttttgcgtctttaataaggcataattaacacacaataaatcccacattttaaagggtacattataattttttttcactttttaaaattttattgaagtatagttgatttacaaagttgtgacagtttctcctctgcgttatattaagttttgaccaaatgagagtgtgtatctttagcttattattttatttgttcctcaacaacctcttgacctttcttatttccattttgtagataagcaaaccatgggccacagtggttaaataaccttcctggggtcaagtaagtggctgagccaagattttgaaatgcagttgtctaaaaagtgccccccccccttttggtttttctgtcttttccagggctgcacccttggcatatggaggttcccaggctaggggtctaatcggaactgtagccgccggcctatgccagagccatagcaactcgggatccgagcctcatctgcaacccacaccatagctcatggcaacgccggatccttaacccactgagcgagtccaggaatcaaacacacaaactcatggttcctagtcagattcgttaaccactaggctatgatgagaactccaaaagtggcccttttgagccaagattttgaaatagaggtgtctaaaaagtgaccctctctgtttttaagcactgcactctgcagtcctggtgccttgggtttcctttagttaatgtctgagacctcctctgtaatttatccacagtcccttctcacttgtttcattattggtgtatttaaagtttttttttattaagatatagttgatttacagtgtttcttcaatttctgttgtatagtaaaatgacccaatcacatacagtttcctgtgctgtacagttgaaccccattgtccatccattccaaatacagcagtttgcattcaaaaaccccaaactgcctgtctatcccattccctcccccttcccgcctggtaaccacaagtctgccctccttggccatgatctgtttctattttgtagttagggtcatctgtgccctattttagattctacaaataagcaatatcatatggtatttgtctttttctttctggcttactgtatgagaatctctagttccatccatgttgcttgctagtggcattagtttatcttttttatggctgagtagtattccattatatatatgtaccatatcttcttaatcgattcatctgtcagtagacatttaggttgtttccatgtcttgtctattgtgaatagtgccgcgatgaacataggggtgcttgtatctgtttcagtgaaagttttgtacagatatatacccaggagtggtattgctggatcatatggtagttctgtatttagtttcctgagctacctccatactgttttccatagtggttataccaatgtactttcccacccacagtgaaggacggtacctgctgttggtgtattgatgttttcttttctttctttttttttttttttttggtctttttgtcttttagggccacaccctcagcatatggaggttcccaagctaggggtccattcggagctgtagccacagccacaacaactcggaatctgtgatctacaccacagcttatgtcaacgccagatccttaacccactgagcgagaccagggatcaaactcgcaacctctcggatgctagtcaggtttgttaacagctgagccatgacgggaactccagtgttgtcttttgtaacaaaaaagttttaaaccttgatcaggtcccatttttcatctgttgtacttttagtatcatatctaaaaatccattgacaaatccattgagggtgtattcccatgttttttgtactgagtttcgctcatacatttatgtctttaatccattttcagttaatttttatgcatggtatgggataggggtccagccagattcttttgcatgtggttgtccagttgtcccagcactatttgtgaaaataatagtctttccccattgaattgaaactcactgagtgaggccatgctagtcagtttgttaacggctgagccacaacaggaactccaagtccaccaattttaagtgtacagtatgatgagtttttattacagtagagttgatttataatatagtgccaaaataatgagggttttttttgttttgttttgtccttttgttttttcttgggccacaaccacagcatatgaagcttcccaggctaggggtccagtccgagctgtagccccagcctacgccagagcctcagcagctcaggatctgagccatgtctgtgacttaaacaccacagctcaccgaaacaccggatccttaacccattgagtgaagccaggaattgaacccgcaacctcacggttcctagttggatttgttaaccactgagccacaacgggaactccaataatgagtttttatgtcagatttatttggttataatttcaaccttgactgattgattgattgattcattcctttattttggctgcacccatggcatgcagaagttcccaggctaaggatcgaacccgctacagcaataaacagagccaataagcagtgacaatgttggatccttaacctgctgagtctccaggaaactcctagtatatcttttaaggtttttttggatctgcctttagtttggggagtggcagttttttgaggtataatttacatatagtaaactcattatgtttagtgttaagtgctttgagtttgaccaaatgtatatagttatgtaatcactactatagttaaagtacaccaggagttcccgttgtggctcagtggttaactaacccgactaggatccattagaattcaggttctatccctggccttgatcactggattaaggatccagtgttgaggtgaactgtggtgtaggtctcagacgcagcttggacctcatgttgctgtggctgtggcattaggctggcaggtgtaattccaattcaacccctagcctgcgaacttccgtatgctacgagtgcggcccttaaaaaaaaaaaaaaatacaccaccctgaagttcccgctgtggtgccgcagcaggacctgcagcatctctggagcactgggattcaggctcaatccctagcttggcacagagggttggggatccaccattgccacggctgcagcttggatctgatacctggcccagaaactccacatgctgcagggctgccaaaacaggaaacaaaagaaaaagatacatgatgctataaagttccttcttgtgcctgtgtgtgtattttttctttttagggctgcacccatggcatgtggaagttctcaggctaggggtcaaattggagctatagctgccaacctacaccacagccacagcaacgccagatctgagctccatgtgcaacctatgtaacagctcacacaatggccgatccttaatccactgaggaaggccagggattgaacccacatcctcatagattctagtctgattcattaccactgagctacaacaggaacacctgtatttttttttaatttagtttttattttatattgtagcatcgttgatttacaatgttgtattagttttaggtgtataacaaagtgagttgtctgtataaccatttttcagattcttttcccatgtaggttattatagaatgttggtgctatatggtaggtcctgttgattatctatttgatagatagtagtatgtatatattaatcccaaattcctgacttatcccaccccatcctcctttcccctttagtaaccgggaggagtttgttttctgtgtctatttcttgatacagataagttcatttgtatcatttttaaaagattccatgtataagtggtatcataggatatttgtctttgcctaacttgatttatttatttatttttatatatttttttttatttttatttttttttttgtctttttgttgctgttgttgttgttgctatttcttgggccgctcccgcggcatatggaggttcccaggctaggggtccaatcggagctgtagccactggcctaccccagagccacagcaacgcgggatccgaggcgcgtctgcaacctacaccacagctcacggcaacgccggatcattaacccactaagcaagggcagggaccgaacccgcaacctcatggttcctagtcggattcgttaaccactgcgccacgacgggaactccctgcctaacttgatttagtatggtaatctctgtgtccatccatgttcctgcaaatgacactctgccttttttttttttttttttttttggcagagtaatactccattgtatatatgtaccattcctttatccattcctctgttgatggacatttaggttgcttccatgtcttggctattgtaaataatgctgcagtgaacatttggctgcttatatcttttcgtttttagggccgcacccatggcatatggaggttcccaggctaggggtcaaattgcaactacagcttccagcctgcacaacagccacagcaacacaggtcctagccatgttggtgacctacaccacagcttacagcaacaccaggcaaggccagggatggacccgaaacctcatagttactagtcagattcatttccactgtgccacaatgggaactcttctttttgaattactgttttctttgtatataggcacaggagttgggttgctggatcatatcgcaactctatttttaggtttttttgagaatcctttgcacattattaggagggtcctgttttctctgtaccctctccagcatttattgtttgtatactttttttttgcttcacctttggcatgcagaagttcctgggccagggacacaagccatagcagcgacaccaccaggtccttaacctgcttaaaccacctgcgaactcctgtttgtagactttttgatgatggctgactggtgtgtggggatacctcattgtagttttgatttccttttctctaataattaatgatattgcctatctttttattttttatttatttagttttttactttttagggctgcacctggggcacatggaggttcccaggctagggatccaatcagatctgcagctgctggcctacaccacagccacagcaatgccagatcccagccatgtctgcgacctacacaacagctcacagcaatgctggatttttaacccactgagcagcgaggccaaggattgaatctgcatcctcatggatgctagttgaatttgttaaccactgagccacgaagggaactccaagttgtcttacttctaatagggtcttttttttttttttttttttttttttggtctccttaggaccatacccacagcttatggaagtttccaggctaggaatcaattggagctgtagctgctggcctataccacagctcacaacaacacagatccttaacccattgattgagcaaggccaggattgagcaaagccagggatcaaacctgagtcctcatggatactagtctgttttgttacagctgatctgtgatgggaactccctaatattgtctttttcgtagattctctgcataaataattatgtcgtcttttattaaagacagtttttttcttcctgtccaatcatcgtaccttttgtttctttttcttgctttattacacaaagtagaacctcaagtttgagtgtgttgggctgggggtcaaacccaagtcccggtgctctcaagatgccgctggcccgttgtaccaaggcgggagctcctgatcttagcttctttgagattcagtttttgaatgctttgtcctgaaatactaaagaaaaaagtgaaaagttaagcataatctgagtgcatccaaaaagaaaaaaaacaagaatgaatttgagcttttctcagtttcagagaatgctattatatgctaacattccctttgggtgttaagcacctggtaaatcagcagtttcaacactcttgtaccacattataccactgtgagtcttttattattttccttgttgaccagtttgttctattaaaaagcaattactctttttattagtcaaagatacaactgtataatcaataagaaaaatagtgtgacttctataaaggagttttatgttttaaatgcttttaaatagccttgagggacgctcttgaatttaaaggcaattagtggcatttgtttaagccttttaactgtggcatctcagcacagcacactaggataagataatcattctgagcaagatttagctattttatagcctttggctactgactacaaataaatagagaaactaataaattcagatagtgtttgaaaaatgagggaattgggttacacttcattatgaaaaatttcagagagacagcatagcctaaaaatgaaaagtctttggattatttggatcaaatgccagctctactgcttatgaattgaatgattttggtcaagatatttaactgctaagattcagtttcctcacctgtaaagtagggataagagaatttgacatagtgctcaccatagtgtctagtttgtagtaataataaatgatatgttactggtcatatttcttagactttctaatttctctacctgtgctgtgtatgaggtaaaaagttactgttagaaatggaaggaatctcagaagtgatttggttgaagacagtatttcctaggttagagaaggtgatagagttggaaactaaaaccagctggcctcgaagtgctcagtcttgctttagacttctcgcctgaattgtgcttttctttggatgttttgtatttgtggcttaattttaatgttgtgattgttttattagagtgagattccattactgttacttcggggtaactgatattttaggaatgacattttactgtattaaattttttttttcatcgtttcttaaagggcttaatcttttccattgaagcaagcctttgggtgcattatattctctaagttcacttggaaatagagcccatgttactggaaattatttgataactgacattggtgtactgcattgtttcagagggagggctttgtcagagaaaggcacttgttacatagatcctgacagaggtgcttattatttagaagtgaaaatgctttgatacttatttaacttattttcagatgattttctgcattgcaaacccagtacttagttttagaggtgagggagaaatatgggatataacttaatgttagtcagatatgtcagttaaatcaggaatagaatctatatattgttcctgagtgtaacttttcataagtgattgattacttttggtgtaaagattattatatttggtaatggttatttctttaagtaggctgtttttattattacttcatttatttgattttgaccatatgcatattcttttctttggctgcacccacgtcatacagaaattcataggccagggatcaatactgtaccacagtagtgacccaagctacagcagtgacaatgctagatccttaacctgctgagccattaggaaactaccctccccaccacccctttctttttggccatacatgttcacattcttcatccttcccatgacctataactgttctgggcctctgagccaacaaagcacagagagactcatacttaggcaacctttatactaaatattagacgagcctcccctcccccctccagatagcctttgttttatttggatgaaattataagttattttaaatttaaaaataatttttagcttgtttagcctgttgaatttagtaaacataacatttaatcttttcagaggtcgaaacagtagcaaaggactgcctcaatctacggtgagtgactttattaatgttacttgtttgtaaaaattgcaactataatatgacttctaagccatagaccaaaagccaaggctggggaaaaaaattcccttcttttgaactttatatctcagataacctttataagtcagtacagttttgtataaaattattagctatgtctgttgtttttctgatgatgactctaaaatgtagaattgtttataaataatatttttatttttcatgcttaatagcagtagctcttttgttcctttatagatgactaaaggcaaatgtaaatgattaatgggaaagatggaactaggaccggagtttgcaaagctccttgggttttttgattttgaagtaatgtgctatctttggtttctttcaatttcccccctcgggaaagggcctctggttttaaattttggaactctatcagttaaactgtgcacgaggggcggaaggtctaagttccgtaggatgcaagaaataaatcagaagcggttaataatttttgagactttgcctttatcgtggatagtttttcttctttagaatcaggacacagctttatctggtgtgtgataagtcgtgatgtggttgattagaccttagagcagtatcattggtttagatatgctaagagaagatagtcaagggtctgctgcagaggttcctaccactccatttatttattaaggtatacttaatcctagttagtgtatagttctgtgagttttgatgcatacaattatataagcaccaccacagtcatattagaagttttatcacctccagaaatccctcatgccactttgtagtgaatcctactcttcattcattgattgctcttctgttgctatggttttgtctttcttcatatttgaaagttctcttttgctttttgtatcatatatagtcaaaacattgttagttggtatgactgatttcactttgagaactgatactctatgaggcaaaagattatggtaaatgaagtcttcctttaactaaacattttgtagcaaaagaaatattaactttaatatttatacaaagataatgtgctaataatgttttttcttaatatttcagatttcttttgatggaatctatgcaaatatgaggatggttcatatacttacatcagttgttgtaagttatgagtattggggagaacctgtcttgggagtggaataaaataatttcatgaagttaaaatgtgaataaatgattctcaaagtaacatttcttaggtcatgtttaatcaggatgatttagaaaaaactgattagaactttattcaagctgttgtaacttgctataaaagcattcttgttaaccctgctgcatacgaagtaacgttactggttgattgtctttagtgcattattttgtcacttaataaaactagagtcaaaaatacaaaactttagtattcaaacttataatgtagactttggacagggcttcttgaaaaattttgagaactcagtgtatttaaccttttttattctgtcattgatgacctaatatgttgaatgaagtccgatgaactataagaagtaaaatgaaagcagttatcccccatgactgcatcacacactgttgctttgataaattttatgtttttagggatccaagtgtgaagtacaagtgaaaaatggaggtatatatgaaggagtttttaaaacatacagccctaaggtaattttcactctttttctctttttaaaatgtaaaatcccatgaatcagcaactactgtatgtttttatgactttctgatagttttatgattttgttatttttgatttagcagtttatagttatgaggtagatatgtttgttacattttcatgctcagtacttgactttgaaagtgctttttaaactacttagagtgatcttgctcttcagtttcagataatgattattttataaacaggtttgtctaatcaaaaagacctgttgagagttcttgtggctcaacggtaacgaatctgactaggatccatgaggatttgggtttgatccctggcctcgatcagtgggttaaggatctggtgttgccgtgatttgtggtatagttcacagacatggctccggtcccatgttgccatagctgtggcataggctggcagcaacagctccagttcgaccccaggcctggaactttcccatatgcttcaagtgtggccctaaaaaagcaaaaaacaaaaaagagacttgttggtctgtgtgcttattaatatatcttggcctttttagtccattgtgactagaagagggatctggtggttcactgttttcctctttaccagtattgtgcctcagacagaccatgtcagcaaaggccaacttttagataagaggatttttcaatattggaatggatcatagattgtatttctgagaaaaaggtatgataatgaggatatcttgaaataatttttactaatggcatataagaaatagtcccctgggggttcccgttgtggttcagcgaaaaacgaatctgactagcatccatgaggatgcaggttccatccctggcctctctcagtgggttaaggatctggcgttgccgtgagctgtggtgtaggttgcagatgtgactccatgttgctgttgctattgttgtgatggaggccagcagctccacttggatccctaggctgggaacctccatataccatgggtgcagccctaaaaaagacaaaaaacaaacagatgctgtaccctgatgtgccaaagaattcctgtcaaattttattttataaatattttgaatatttactgatgtttttcttcctagtgtgatttggtacttgatgctgcacatgagaaaagtacagaatccagttcggggccaaaacgtgaagaaataatggagagtattttattcaagtgttcagactttgttgtggtacagtttaaagatatggactccagttacgcacgaagaggtgaattttgagttcctaaacatgcttcatggtttattagatttattcaagcaaagactcttcattgaccatgtgtacttttcttttcattctttttttttttttttttttttttttttaaataagggcttttttgcctaagtaggaattttaatgtaaaattcaatgctggaaaatatttaaaatttcagaggaagattccttggtccttctggtaggataaataatggaagtttgttttttattaaaaaatagtttgtaggaggtcttttgtggcacagcaggttaaggatcgggtgttgtatgatggtgggtcaggttgctgctgtggtgcaagttcaggcaccggcctaggaacttccatatgtaatgggcatggccaaaataaaaagtttgtaaagcattttcgacagttttatggtcacaagtgctactgattatactcagctgataattccttgtttccattagacttaaaatgttttagcttatgtatatttttagttttataatgtttgtaaataatgcttacataattttactgtgcttgttctgcagatgctttagttttttaatctgtaaagaaatcaaaaccacagagctcagggagaaaggcaggagctgtggatgggaaactagtgtccagtgaagctgaaaaatgtaaagaagtaggacatgtatattggaaaaaacattgagagtgtgggactgtatattttattttatgttttgagaatataaaaatggtgatgtatctgtattaaaattcactctatttcaagtgtctgttgagaaggaaagtatgggaattgctgttaacccatttggagtgctgagtgttcagtaaaacattgaaaggcctttctgggaaagtttgaaattggttcccaatttcttagatgattttttttttttttttgaagggaagagggagactttctctagtcatttctattgcaaattacaacaacagtttttgattttcatgatggcatctgtactagcagctgttttagttgttgcactgatttgtctttgttgttatttagaaattgcaagccgccagaaagttaaagcctttcttctggacctcttaataaggttctcacctatagttagattctttttttcagaagctagtagtgctaggtactctgtaactgctttgcgatgctgaagaaagcactttgttctggtattgtatcttctcagatacctatgacagatatctctttgttaaaagtccttcagtggcccatacaaggagacaagtctttttttttagttactgcctttggagttgatcttgtttatgcctaggagcaccacagctcacagcagtgccagatccctgaccaactgagtgaggacagggatgaaactcacatcctcatggatactagttggatttgcttccgctgtgccgtggcagaaacacccatgtcttaaatttaaatatttaagccattttgagtttacttttgtgtatggtgtgagggagtgttctacttcattgatttacctgtggctgtctagctttcccaacaccacttgctgaggagactatcatttctccattgtatattcttgcttcctttgttgatgattagttgaccgtaggtgggtgtatgggtttatttcttgtctctttattctgttccattgagatgtatgttttagtgctaatataaaaagtaacattctttttctttttttttttttttttttgtctttttgccatttctcgggccgctcttgcggcatatggaggttcccaggctaggggtcgaatcggagctgtagccactggcctacaccagagccacagcaacgcaggatccgagccgcgtctgcaacctacaccacagctcacggcaacgccagatcgttaacccactgagcaagggcagggaccgaacccgcaacctcatgcttcctagtcggactcgttaaccactgcgccacgacaggaactccccacattcttttttttttttttttacggccagtcctgtgacatttgaaagttggagcttgcagctttggcctttgccacaggcatggcaacaccagatctgagccatatctgtgacctgtgtgatagcttatggcagcaccagatccttttcccactgactgaggccagggatcaaacctgcatccttaaagagacaacggtctcaggtctttaacccgctgagccacagcgggaattccaaaagtagcattgttgaactccctcttaggtaatttaaatgggtctaggacatttttcaggaggacaattcacttggtaatattgtgtaatgctagtatacccaataatgcctgtttttagtttttatttttttgatttttagggctgcactcaacagcatatggaggtttgcagactaggggttgaatcagagccgtagccgctggcctatgccacggccacagcagtgccaggtcccagtcatatctgcttcctataccacagctcactgcagtgctggatcctaaacccactgagcgaggccagggatggaacctgcgtcctaatggatgctagttagattcatttccactgagccacgacgagaactcctgtctggttttggttttattttctttcttgctcttcacagtctcacaaagttttacaaatagaaaatttaatattaaaactagtggagttcgaatcgtggctcagcagaaacgaacccgactagtatccatgaggatgtgggtttgatccctggcctcacttagtggattggggatctggtattgccgtgagccatggtgtaggtcacagatgtggctcagatcctgccttgctgtgactgtggcataggccagcagctgcagctcttatttgtcccctagtctgggaacttgcatgtgccatgggtgtggccctaaagagtaaaaaaataaaactagtaataaagcatggcagtgaaggaatgtgggtaaattttctccatcttaatttttattccatctgactgtaaataggaattgactgcttttttacccagatcagacttggcaaagagttttaagtgagcatgtgtacttgaacagttgttcttctaatttatattagaaaagaacagtctgaatctgtaaaatgttttgcatatctgctaaggaaacagaatggtgtttgtatagctgtttaagaattggaattaatttcatttattaacttttttttaaacctatttctgaacacttttgctgtaggtttaagagttgtaaaaagactaccgtgctggctaatattgggaaggaccattcccacattctgttttttgattccctcacacctctgaacttaggttgggtttttttgccctaaattttctaccaaatcactttctttcccttatcctttctctttctttcactgttgagatgaaatagtaccttttataaaaaactgcttaggagttcccattgtggtgtagcggaaacaaatctgactaggaaccatgagattgtgggcttgttccctggccttgcttagtgggttaaagatctggtgttggctgtgagctgtggtgtaggtcgaatacgtggctgggatccagcattgctgaagctgtggcataggcctgtggctgtagctctgattccactcctagcccgggaacctccatatgccgaaggcgcggccctaaaaagcaagcaaacaaacaaaaccagactatttcattctttcagatggcacaggctaaagactcctcctccccccctcaaaatggggttcaaaaccaggagcctaatagaggagcttaaaacagaatgttcatctccagatgctggccccaagtactttagtcaaacttgtgggtagtattgtagcatcaaaaacatttgagtggtggggtttccattgtgtcacagtggaaattaatctgactagtatctacgaggatgcaggttcaaaccctggccttactcagtgggttaaggatatggtgttgccgtgagcagtggtgtaggtcgcagacttggctcagatctggcattgctgtggctgtggtgtaggccagcagctgcagctccaattcaacccctagcctgggaacttcctactgagcaaagccaggaatcaaacctgtttcctcatggatgcagataccattccagataccatttcttttgatgtctttgttagaaattcttccgatttcttttggtgataatgtgggaattagaaacctaacatttggagttcccatcatggcacagtggaaatgaatgtgactaggaaccatgaagttgtgggttcaatccctggcttcactcagcaggttaaggatccagcgttgccgtgagttgtggtgtaggtcgacgaggctcggatttatcattgctgtggttgtggcataggctggcagctatagctctgattagatccctagttgggaacctccgtatgccactggtgtggccctaaaaagacaaataaataaataaataaataaataatctaacattccgtggcacctatcaccttgtttttttttaatttggcaagcttcaggaggtaggcttccatttttctctttttcttctgcattaatctggctttactgtagaatttggtgtgccatttgactctgtgaagtcttgactactgatcttcattcagatcttccaaaggaatctggtttgtggatttaattttttttccctctgatccttgattgattgaagtcaaatacaagagcattttatttatttatttatttatttatttatttaggccagacccacagcatgtggaagttcccaggccagggatcaaactggagccccaatagcaacctcagccacagaagtgtcaatgccagatccttaacctgctgagccgccagggaactctcagcagcatttaagtgatagagtttctagacaatttcagctcaaacttttaggtagtttaggttttaagaaaattgctttcgaaatgttaaagtattgattacagtgcctattgggtatataatggccctagtaaaagcgaggtgaaatattttgtcttaaaaaaatattttgggagccacattcctttgtggctcagcggtaatgagcccagctagtatccatgaagatgcaggttccctccctgaccttgtttagtgggttaaggatccagcattgctgtgagctgtggcgtaggttgcagacgaagctcggatttggtgttgtgactggtataggccagcagctgcagctccaattcgacccctagcctgggaacttccaggtatggccctaaaaagcaaaaaaaaaaaaaaagcctaaagttttaactcaggaatctaatttataaatctcacaaatagtttattagttaaggaaaataaaaacttctttttaatatttaagtagtacacaccacatgtttttggtaaacctggtactaaaccgttcatagacgaccagcttctgtgttggggattcgtatgtagcagggcagcttcctcgctgcaacttactgttaagggctattgaaggttagccctagacacaagagtttgaaaaaacaaataagaaagaaagaaaaaggaagaatttaagtaagatatatttttctctcaggcatttttttttctatttttatctcattttatcatagtattgtaaaatttaatagttcattgtgtataggaggaaaataaggtttcttttctttttttttttttttttttttttgtctttctagggccacacccgtggcatatggaggttcccatgctaggggtctaatcggagctttagctgccggcctatgccacagccacagcaacgccagatccaagccacatctgtggcccacaccacagctcatggcaacgcctgatgcttaacccactgagcgaggccagggatcaaatccgcaacctcatggttcctagtcggatttgttaactactgcaccaagatggaaactcctgtcttttttttttttttttagggctgcatatggaggttcccaggctagaggtcgaattggagctatagccactggcctacaccacagccacagcaataccagatccttaacccactgagcaaagccagggatcaaacctgtgtcctcgtggatgctagtcagattcgtttccactgacccacaataggaactcccagaaaaatgctatttttaatactgttctagtacatattggagcctcttacttctcgccacttaattgctgcatttgtttttgaaaggctagattagctgtccctttttcttttcctcttttatggctacagctgtggcatatggaagttcccaggctaggggtcagattggagttgcagctgaggcctgtgccacagccactataacacagagtctgagttgcatccacagcctatgctatagcttgtggcgatgctggatccttaacccactgagtgaggctagggatcgaacccacatcctcacagagactacatcaggtccttaacctgcagagctgtaatgggagctcccacctttcacttttaaagccacagccttttgttcctcagaacttttttcttaattctattttagccttttacacattagattctaaaagatgtgcttcaggagttcctcctgtggctccatgggttaagaatccagcattgtctctggcagtgcaagtttgatccctggcccagcacagtgggttaaggatctggcattcgctctctggtcagggaacttccgtatgccatgggtgtggcaataaataaataaataaaagatttgcttcagctctgaattattctccttcaactgaagaaacttctgcagcaaatgacagggattgtgtcttcgtcaaatacgaatccccagctcatactcagtaatactaaaattgaataaaaaatggtctcttagttgcttggttggcacccacttaaaactgatgctctgttttgtatatattggttcacataaagctcatggtacattatggggaacttttttaaacttgttggaaaatgtcacagtattaataatttgtcaaagcagaaaattattgggagttcttgtcgtggctcagaggaaatgaatctgactagcatccatgaggatacaggcttcaatctctggccttgctcagtggattaaaaggatccggcattgccacgagctgtggtttaggtcacagacacggccagatctggcgttgctgtggctgtggcataggccggcagctgcagctctgatttgacccctagcctaggaaactccatatgccatgggtgcagccctttaaaaaaaaggtatcattgaaatagtattgttgaaatctggaattttagtgtttgagaaaaagcagatttaactgagagatgaaatgggtagtgaggattttggtgaagacttctgaaagcacttgtgaaagcttctgatatcaaatgtgataaggattttttgatttggttcagttttatatcatttgtaggctctttatgttacgtctttttagggccacgcctgtggcatatggagatttccacgctaggggtcgaatcgaagctatacccgctgacctacaccacagccacagccatgccagattcgagcctcgtttccgtagagccatgatgggaactcctcattttgtagttttaataaatttatttttattaacttgaactatgtcactagcatattagtgttcttcaccactattctggccatttaaaaaattcccagacaacttcgacttttcagaatcataattggctgagagataaaagaggaaaagctgaggagcagagcacatatactatttcctgggtgtggggctcagggagaccaaagagactgtgctttagttgagacatatctttccagtcaccagcaggtggcatcactggcccttaatgactgggtttctgcccccaatcagaaggaagggaaagtttggaggtagggcataatcttgtgccgtgtccccttttccctaaattggatgttatagggcaggaaatgaagcagagcttcattatcttttattatctcatctgatcacttttattttttttctttctatagttccttcagaaagagataacatttttctgacagtcaatttctttctatacttccttcagaaagagataacatttttctgacagtcacaatttgtattgttgcatcttgcttttaaatacttttgcttttttaccatagaggataatggaaaattaatatactctgaatttatggcattggaaaaatctgcacacagaattccacacttgaaattagattaaagccaatagattttctgaattttgcagaaatcctgacagtaacattgtactatttaataccaacagtggtttttcaaaaatccaagcatggtggttaataaaataacatattcagaatttacagtagtgggtattggtaatagtgtagaatggaatatccaagtctagcttcattctagctaacgatacaatgttgaccagaagtacagtgtttttttttttttttttttttattgctttttaggggccaccctgcggcatatggaggttccagactaggggtctaatcagagctgtagccactggcctacaccacagccacagcgacactagatctgagctgcgtctgtggcctacaccacatttcatagcaacgctagagccctgatccactgatctaggccagggatcaaactcacctcctcatgggtcttagttgggttccttaacccctgagccatagcaggaactcctgaagtacagtatttatgatgaggatatttccctgcatcctgacactatagcctcattttgctgactctccacttctgcaaacttacgcatgtctctctctaaacaattcactcatctttaaaaagggactttcaggagttcccatcgtggctcagtggttaatgaatccgactaaaaaccatgaggttacaggtttgatccctggccttgcttagtggttaaggatccaacgttgccatgagctgtggtgtaggccggaagctgcagctccaattagacccctggcctggaaacctccatgtgccacaggagtggccctaaaaaaggcaaaaagacaaaaaaaaaaaaatttaaaatttaaaaaaaaaataaaagggactttctttgggggactttctttttacattaaggagtattatttctggagttcccatcatggctcagtgggtaacgaatcagactaggaaccatgaggttgtgggtttgatccctggcctcactcagtgggttaaggatccggcgttgctctgagctgtggtgtaggttgtagacgctgctctgagcctgtattgctgtggttctggtgtaggctggtggctacagctccaatcagacccgtagcctgggaacctccatatgcttcaggagtggccctagaaaaggcaaaaagacaaaaaaaaaaaaaaaaaaagggagtattattccttattaataacacccttgttttcccttccctcatttctgccttgataggaaaacataatgctaagtaacatgtgaacagttaattcttttataagattggtattataaacagaagatgtaacataaaaatgtagcattgaaaaaaatatgttatttaataatggcctcctaatacagcctaaattgaaatcagcagggtaaaacttggttcagtgaagttttattagatccttgctttttcacattggttcccattcagggatcttttttgattttgtttaaaataatagtgatagaagtatatgtaagctatttttattgtgtatttatttcactctttcagcttgaggacagtgtggttcagtccctcgtctgccataaatgctttgacataacacacacataccctgcaatgattaaaaagtccatttatgtgattctgctttaaaaaaaaaaaaaaagtgtcttgctgttctggggtttttctgttgttgttattttgttttgttttgtttggggcctcacctgtggcatatggaggttcttaggctataggtcaaatcgaagctgtaactgcaggccatggccatagccacagcaatggggggacccgagctgcttctgcgataatatcagtctgttagaacctcttataaatcttttccaaaatacacctctcttccagtgaatgctcatcccactcctagttgaagcctgctgctttgaggatgccacttggtatgttcttggcttttataattgccagcaacgggagccctgctacctgatagagctggcagctaagcccatagtgcagttatgctttaattccctagtatgcatgaacacatacccacatccacccatccactcctggtttgaggtgagaggatataggagttaactaggtttacagtgccatgcctataaatttgctggctcaggtgttttattttgccattaacttgcctacttgggagtcaaagatggttacagaaataataccaaatcaaaaacccctctggaattgtatcttttgaaggagacacaactgtttattctttccttcctcctccttggtggcagcttgcaggaggggtgaaggcagagccagatcagcagtattacttaggggattccctgtaggtccagccttctaaatgcaagcctatatctccaaagcatttcctaacactatcattgcccaagtacacctttatgtatctgggtcctaactcccagctagaggaaaatttcctttcctgggcagcagctatgagatatatagttcctgtcaggtgagcctactgatgccatgttgctctcacaagctggttctcagtaaaattagtagaggagcagaggatatattagttgagaatgttgacaggaagtccaggtagtcctacctcctgaaccttctggagataagtaataccatagggcctgaactgtgtacacagtggctgtcaggaaataccggttctgtgaggagatgggtcacttagaatggcttcaaatactaatgtcaagagtgtgttaggatactcactcctgcatatagacatggatttggaaagtttaaaaaattatatatgtggagttcccgttgtggtgcttcagaaaccaatctgactaggaaccatgaggctgcgggtttgatccctggccttgttcagtgggctaaggatctggcgttgccgtgagctgtggtgtaggtcgcagacaaggctcagatctggcatggctgtggctgtgtattagacccctagcttgggaacctctatataccgcgagtgtggccctaaaaacaaaacaaaacaaaacacaaaaaaaaaaacccactacatatgtttggctgcaggagctttgagggtaaacgtaattagtgtatctgttaaaagaacttttattttaatggattggtagaaactttctggaccaattctgaaacacaaagtaattttttttttttttttttttttttagggctccaccgtggcatatagaagttcccaggctaggggtcgaattggtgttgtagctgctggcctgcgccacagcaacagcaactcgggatccaagcggagtctgtgacctacaccattgcttatggcaatgctggattcttaacccactgaatgaggccagggatcaaacccagatcctcttggatactagatgggttcttaactcactgagccacaatgggaactcttaaaataattatttttaatataatttatgacttatgtgaaaatattttaacatttcatgtggcttaaaattacataggtaaaatattctttcatcctaatcatctgtgatgcatttagagagttaggtttttggaaggttatagtattaactgaagcattacatttctgaaagcatactgttaatgctattctttctgtatcagaaattcccttttcataattatttttaccatatatatctttaataattcatatatgtatttatgtagtccattgtttggttgtgtgatctttcaaccaaaaccatcctttgcagatgcttttactgactctgctataagtgctaaagtgaatggtgaacacaaagagaaggacctggaaccctgggatgcaggtgaactcaccaccaatgaggaactggaggctttggaaaatgatgttgtaagcaaaatctttttgattagtatcccatcacttggttttaatttaagtatgttattgttttagtgactgtatttaaagcagttttattgtgtaaatggagacttcctaccaggcagtgtatacagaatgtttctttgggatgcttataaattacttctgtttttttgtttgtttttggtttttttgctttttagagatgctcccacagcatatggaggttcccacactaggagtccaatcagagctgtagccaccgacctgttccacagcagcgtcagatccgagccgtgtctgcaacctacactacatctcaccataacacgggatccttaacccaccgagcaaggccagggattgaacttgcatccttacaaatgctagtcagtttcctctgagccacaacaggagcttctatgtttttatttatttatatatatatattttttttcttttaatttaattttcctttttagggccacacccatggcacatgaaagttcctaggaaggggtcaaatcggagctgcagctgctggcctgcgccattgccccagcagtgcaggttctgagctgtgtctgtgacctacaccacagctcaaggcaacggcagatgcccgaccccctgagcgaggccagggatagaacccttatccttatggatatagttggatttgtaacccattgagccacaatgggaactcctttgtttctaaagtaagttttaataggagttcccatcatggcacagcggaaacgaatctgactaggaaccatgaggtggcgggtacgatccctgtccttactcagtgggttaaggatccaatgttgctgtgagctgtggtgtaggtcaaagatgaggttcggatcccgagttgctgtggatgtggcataggccagcggctacagctccgattagacccctagcctgggaacctccatatgccacgggtgcagccctgaaaagccaaaaagccagaaaaaaagagtaagttgtaataagcaacttaaaaatttaaattggaaagggggggggtgctagaaacactggcatgttttattttgaatgttctgcaaaatgaggcagcctgaggaaatggtgtctgttgactacctagaggtgaggtcaaagtgtgactttgagggttcttttctgtggaagaggtactcgttactaagatatataggttacattagaattagagctagaagaagttcctgttgtggctcagcagtttaagaacctgacatagtgtctgtgaggatgcaaattcaatccctggcctcattcagtcggttaaggatctggagttgccgcaagctgcagcataggtctagatggagtttggttctggtgttgctatggctgtggcataagcctgttgctgcagctccagttcaacccctggtccaggaacctccatatgccacaggtgcggacctaaaaaagaaaagaaaaaaaaaaaaaaattagagcagtaagtgagtttcttggtcttaaaattagggaacattctctgcaaaaatctgtttccaaaagtctcttggcatatattattacttttccaataacatatcatctataaatcaaatacttaataatgtctatcattaggattctatagattctatttctgaactgtaaagataaaagcaaagtctcttgtcatttgagtatttaggtagcaaaatttgaattggataaaaaaatctttcattgaatatttagagaactctttttaacaaatttgtgtttgatgtttaagtcatttccacttgtaaaattggaaatacataggcaacttgtcattattaattttcgaacttttaaagaattatatataacttaatggggatgttcttggctttgtgtagcacattacttttgtggaggatatggagaagtaggcactgtattgataatgaaatggataaattgataggcactttctagagagcgttaatgacaatgtttatcaaaatttaaaacacacttttatcaattctacatttgagaatttatttttgccgtaatatccataagatattcaaataattatgtatgaggatgtttttcacagccttttttctaattgaaacatcctacctgcccatgaatagggaatgggttaaatagatttattgtacctccacttaattgaaatactgtatgtctactgaaaagaatggtattctgtaatgggaagataagacttattaagagaaaaagcacgttgcagaaaaaagatgcctacttgaattttcaaaacagctgattgcagagttgtgcagtagaaatgaatctgactaggaaccatgaggttgcaggttcaatccctggcctcactcagtggtttaaggatccggtgttgccgtgggttgtggtgtaggtcgtagacgcggctcagatctggcattgctgtggctgtggtgtaggccagtggctatggctcagattagacccttagcctgggaacttccacatgccgtgggtgtggccctaaaaagacaaaagacaaaaaacaaaaacaaaaaacaaccagctgactgtaatgattatattcttatatatgcgtagagaatgtctggagttatgtccaagaagttgttgatggtagttatctctgcatgctgggattggaagattttattttttgctgaatgtccttctgcatggtttaaatttgcaaggagcatatactttaaagtaattgtacagttttgataggtaactaatttcctgtccacatgtgttaggccaaaggagttgatttagtggtagaattacattatagttttatctggagtagcacagaaggagctaaggttgatgggtatccttaggggcaagctttagtgttgaagttgccatcagcattgctcagatgatgctgtgccctcttctgagatggataacaattatgtgccgtactttaccctttatgaccagggtaaaactcaagaaggtttcaggtaggagttcccgtatggctcagcaggttaaatatcctgcattttcattgtatttgctgctccagcacggttttaatcccttgcctggggtaacttcccacatgctgtgggcacagaccaaaaaagggaaagaaatactaatctttggagctcctcttgtggctcagtgggttatgaacccagctagtatccatgaggatgtaggtttggtccctgaccttgctcagtgggttaaggatccagggctgccatgagctgtaatgtaggccggcagctgcagctccaaattaacccctagcctgggaatttccatatgccgtagatgtggccctaaaaagcaatacataaataagtaaataaatgaattaatgaataaataaaaaggtttcaggtaaatactgtagagaatgaactctggttaatactttatggaaagattattgttaaggaatagtgaaaggagagaaccctgacttgaaggctcatattttatgaggtaactaaaatgttgtaaacttttactaataacatttcaaataattgttttgtatacagttgacctttgaacgcaagtttgaactatttacttacaggcagattttttttttcaatggaaaatactgtgtactgcacagcccaagggtcattgaatctgtggattttctactatagggggagtcagtgtcccttacactccatctcccaaattgttcaagattcagctgtagttagttaccaccttttagggctgatatgtagaagtttttctaaggacgcttttaaaggaaaattttgcctattttttaatcttgctagatttttcctgaatagtatgatactttttttttttttttttgtctttttacatctgcacatgtgtaacctcggcatatggaggttcccaggctaagggtctaatcggagctgtagccatcagcctacacacagccacagcaacgcaagatctaagccacgtctgtaacctacaccgcagctcacggcaacgcctgatccctaacccactgagcgaggccagggattgaacccgaaacctcatggttcctcatcggattcatttccgctgcgccacgatgggaactccattggattgtatgatacatattgttaactgtggatatcgactgtagctgaatttaaaaagacgaatactttgtcatttttgaaaatgagcatcattctcttctagtctaatggatgggatcccaatgatatgtttcgatataatgaagaaaattatggtgtagtgtctacatatgatagcagtttatcttcgtatacgtaagtttttaaagtttgcttttattttaatgcatttgcctttgatttcatcaccttaagttatgttgaataaatgtttttgttggattttaagtaaaacaattatgtgaaagaattttcctattatacccatgttgataaattcttattaaaacagggattattagatatagtttacttacaccgtaactttttgctctaaataaattttgttttatttttacattgtgaaaactctcagttggcaagtgtagaggtaatgggggaatagtcggtttaactggttttggaaatgttatattcctctaaggaaaaggtgacagaaaaacattcaaattttgatttataaataaaagacgactttagctttcttacagttttaccaccactttaaacactaagctctcttaatagttgattgtgatagatatataaactctgacttaaaaacactaattttaacttttcctttcctaatgtttcagggtgcccttagaaagggataactcagaagaatttttaaaacgagaagcacgggcaaaccagttagcagaagaaattgaatcaagtgcccagtataaagcccgggtggccctggaaaatgatgataggagtgaagaagaaaagtacactgcagttcagagaaattccagtgaacgtgagggccacagcataaacactaggtatttaaaggaaatcatgatgcagtattttggatacacaactcaaggtctgtgtgagaaggtgtattgttattattatatttcatcttcctttgacctagcttcggtagagaatgcaaatggagttggtttaagattctcttagagaagagattatagtaatcttggaaaatattttttttgagcatcacctctatgaagctgggtgtagaatatacagtaatgagtacaccaaggtctgtaagaacttgttaaagggtaatgaataggtggtagggtgcatataacataattacagttgagtttggtttgctaaattggagaagtggtcagagtactaggaacatgtgagaaggaaactagtgtaaccttgtaggcttggtgaaagtcttgcagagaaggtggtttttgtgataggatagtagatctgtctgccactcaaagagacataaaagagaggaattccttgtgtggtgaaagtcagatgaaagaacttgcccagtaaaggcaaaaccgatttgttttcatggaatacaggatgtatgttgagggtgcagtcgtggtagctggtgataggaagtacggcagggaagctctttatgtgtcatgttaaagagcacccggtaggtagaggatggcatggaccaactttgggacatagagaactgactgaaacatagaaaacagttattgcattgaaataactcgagtgtgagaacttggtaaccaacttaagcaagactgctaataggttagaaaaaccaggggtgacctgaggtttatttgatagccaagcagattggtgattgtgttggtaatggagattaagaaaaaaaaaaatggagcaagcttgaggagagatataatgagccatttgtgcaatttcttgcatttgaggggctcacagatcttttgtgcatttattcttaaacattctgcatacgcagtagaagatacattttctgtcttcaaggcactcatagtctagagtcatgatttgaattaaagtgttcaatgagagatgttgagactgtgggattgacaatttggagttggggattgatgttgaagccatgaaaaactgatgaacaggagaagagagaagaaatcagagaaaaaacgaagtagagaaaaccaaggaggaagagttttaaggagacatataatgattgagagaatcagccataaagaggccaggtaggataagagtgaatacacatctgttaaattttgtccttagggagagaatctgagggaaaggaaaggtgagaggctggagcttagggtaggatggaagaaccgggtgtctgggggtgaggcagtttggtgtaagtgtttaactttttaataacaaacattcccttctgcctaagttactttttagaaatgtttcattggcctggtacttattaggataaaatgatttagagaatctctcattttcagggaaaataaatatattcctcctggacaaagaaatagagaagtcatatcgtggggaagtgggcgacagaattcaccgcgtatgggccagcctgggtcaggctccatgccgtcaagatccacctctcacacttcagatttcaacccgaattctggttcagaccaaagagtagttaatggaggcaagtattttgaccaaatttctccatatcattgatcgaaatatactgttttctaaatgtttacattttatgttaattgataaggacatgaatacatttaatgatttttgtggagtagttttcacttaaattattttaaatttgccattctggatatcaaattagtaaaaagtaatataagttaatggtgtatacagtatttagtatgatgaattataaagtgctaaatttaaccaaaaccattcacttggcaaaaaagcactccacatacaaagaaattggaaactttgggtaggttctcaatttttaaaccactgggtgataaaattatttagacatagttaacattgaaaaataccagtttgtgtaaaacacctagtgcttaatatagattcatttttatgaactgtttgtttatatatttatattttgtttatttcaaggaaggatttgaggtaacttgtaatacagtacatgaccaagagtcatgtgaacgtggtgaaggaaaaaatgtgcttaaaaaacaatagaaacaactcttagtgtaagggtggatattagagtttagcttaagtaaaagaaagttgcgtcttcagtaggaagatattttttctacctcaaaatttaggttaaattagcttattggtcatggatctctcgtacaagtcagggatactggacagctgtactaaagactgtatggaaatatggtagttaataatactgatactgtgttattaccagggaacagtggctttcaattttagatatgtgaatttggaaagttagaaaaatagagaacactaagtttccaatttcatttgttttcattgaatctttctccagaattcctctccaaatgaacactcttgagtattttctgtactttgtattgggggtgaaatttctttgctcactgagtaaagagttttagttgtttatgaacagaattttcaaagtaaaaaacctgaaaggggctaggaaatgtatgatactcaagtgtgtggaaccctatggagaggagacctggactgtttcctaagattgaggtaagtgatacgtcatgttacatgttagctgtacatcgacctgtgcatatttcttggtgtcagttatttggtgatgactgctctgtagttgcattgtttattaagcagtctcttaaatgaatgtttaattgcataaattatttagaatgtccccctttttcccaatttgataggattaaaataagtgaaaaggcagtggatattaacctgtcactcctgtgactctagaaaatagcagaagtaatgttacatttctccttaaatggtgttgtttaatgagatttcaaactgagctttgcattcaaatatgaactagaagaaaatcacagataattataagaaactagcatttttaatgggatataatagctgatgtttcagaaagctaaaactaatatagtaaataatccgattcctgagttttgtgatttattgtgtgaaattatctagtgtatgttgtactccttttaacaattgattaccgagaaacagttatagaagcaggattaataggcatagtcttaactgtcttcttcaatagtatgtgtagatcctaattaaccctttgggaacgtgtgttcatttaaacagaattttaaggaggttaaagtaaaatgtgaatttatgtcagttaagttatgctaaaacttatcacaaatcaaatgactgtcctcaaagggttaaaatgtacaagaaatcatttttgtcattttacttttttttctgtttactttttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaaggtacaataccacaatttgttcatgtttttgtttgtctttgtttaactcctatgtgagtttataattacaaaatagtttcctcttcattatttaataacctataatttccgtgttttaactttagtttattaaaactatttctattaaccttttgttcactagagagaaatttgataaatgcgtgtgaagcgatgaattatcttgaattgtaagaatgggggtttaatctctgcctggtaatgatgctactgctttatagcccaaggccttctccctcccactttataatgtatgtagtggttaatggtaaaacgtgaactttcttcaccagtcttggacttactgtagagcctgtcattttatagctccctgccaaggttactcgtgattctgcctgttggccaaaggcaggagtggtgatttaaaggtcctttttgagagggacattgcatgtagctgcccctgtgtgtttgcccatagatgacaatacagagtttcattttgtgtttgggagttttaaaaaaaaaaaattagctttgtagtattttattgtgtaatatttatttaatctgcaagaagtccttgatctaagataaaactgttaataaaaacaatgtatgaatctttaagggtctttttacccttgtcaaaaaataaaatcctggagttcccgtcgtggtgcagtggaaatgaatccgactaggaaccatgaggttgcaggttcaatccctggccttgctcagacggttaaggatctggtgttgctgtgcctgtggcgtaggccagcagcaatggctctgattagacccctagcctgggaacctccatatgccgcaggtgcagccctgaaaagacaaaagacaaaataaataaataaattaaataaaatcctgtaattctcattcaatgtttgatgctaaatccaccattgctatatatcagatacatagatgtgttgtagaaaggtcacatttttatttaaatgtagtgaataaattaaaaacctattttctgaatgataatggcctttgatgttattgagagcatttgatattaaaattttaatctgatttgttcattaaaattgcaggtaatattgcttatgttgaaactgatacagttttctggcataaagtgcttgcctagagaaaacatgttgcctgctgtttaataaatatttgccatctaggcagggaggtcatgtgatcctgactaaagaggctaaccttaaacagcccattgcactgattttcaaggttacttccctactcaaaagtgtctgtgatggtggcttctaaaagaaaagtttaattctgatgaagtatttatttggtctattatttgcataagtgatgttcatatcatgagaatatgttagataaaagcaagactcattagtgagtgtgagcttgttcaccatggttagatagaaagattcacgtcagagtataccttctgcatattcagggatgctacattattcactctttatttttaactaattgaatgaaaataggttttctagttgtgtagttaggtgacactgaagtatttttaaaatgtaaacttcaaaataaagctattaaatataatggttttctgtattcaatatagggaattattttgtttctgcaagtattttacatactgccaaaaagactgaattttttaaagttaaattctaactttgatttcattgagctatgccaaccatctttcttggtctttttctataaagggatataaaaatatgtataaatatgcaaatacccagttcctaattcaatcttcagtataaattgtatcttcagtttaaaattatataacattaacattcttaaggtatgtccatgattgaagtactactaaggacataaatgaatttgacagtttaaagagtttggcagcaaggtgccagttcagcagctttggcattgacattaagaatgaactttgggagtttcagttatggctccggtgttcccataggctctcgtgtaggtcacagacgaggcttggctctggtgttgccgcggctgtggtgtaggtctgcagctgtagatccaatttgacccctagcctgggactccatatgccacgtgtgtggccctaaaaaaaaataaaataaaaaaataatgaactttgcactgtcagtgatagtacaaagcctgacaagtgttagcactatcaggcttctctggtaagagccattctgtccactgttttcacctgatgttttgtttgaatgcacagtagacttctttagaaatagaaatcgctaatggggtgacagaattgatgtggaattttgacaattcatatagtgcagatttcttccccaagtgtcagttactctagtctgcaagtcctgccttaaaaccagtagaatttttagctcccagactgttagttaagactgttaagtctgagaaactgcttacaagtgaggactgctttaagatatggattataaaattgatcatcatggcagaaaaggttaataaattaaggttttagagaaattaagggaaatttgaatataatccttagtacaaaaatgtattgaggttaatagttttctctttaaagagtttttttccctggagttccctggcagctcagcaggttaaggatcatcaacattgtcattgctgtggctcgggtcactgctgtggtgcgggttccctggcccgggaacttctgcatgccacctgcacagccaaaaaaaaaaaaaaaaagatactctaaaaaatatatttttcttctaattttataagtaatgtattaaagaaaatttgaaggaaaaagctaaaagtatgtggtaaaataaagattattacatcatgtagctataacctttataaatgttctattatttttatatgcctataaattatggacatagagtaaacaaattgctaaaatctttgcagagttatgacatctcactgtttgatttcttactgcctccttccctttctttaaaaataaggaaaataaactttattgttaaaattttatgtcattccacaaaataattctgagagtatggccaaaaatgtaaatggcgtttgttttcttttttttttaaccaagaagaaatggggggggaaggggagaaatgtgtgtgtgtgtgagagggataaagaaaaagaatagggtgtgtgtatttaacagaaaagtagtactggtggacattgtggcatttatgtgatgttcactgttcctttcttagggcctccaaggatgtccccaaaggcccaacgacaccctcgaaatcacagagtttctgctgggcggggttccatttccagtggcctagaatttgtatcccatacctcaccaagtgaagcagctgctcctccagcagcaaggactagtcccgcagggggcacatggtcttcagtggtcagcgggggtaggtaacacttggcttaaagcataatatcaatgacactttgttattatatttgatgtaaaagggctgagcttgagctctgtttgaggaagtctaagtgtatatatttaaaatagtagagtaaccaggaatttggaaaacagtttttattctgggttctaccacttaagtcaccatatgttggagcaaatcaagtgatcattttgaatttcagttttctcagtgagtaaagtagtttttgcctagtctactttagggtcttgtgatgaaattcatatggggttcataaatatgaatatattttattatggttttataaagggccactcaaatgggaggcaaatacagtgcataacaatttttggaggggatcacatttcctgtcttcttagaaacttggttcattgattccacatttattttgggcttacaggcttgcaatgctatgtgtttctttttttttcccccattcattcatttgaaacatttttattgaggttttttttttttttttctgtcttcttagtgccaaacccatggcatatggaagttcccaggctaggggttgaattggagctgtagctgatggccttcgccacagccatagcaacgcatgatgcaagccgcatcttcgactcagccacagctcatggcaatgtcagatccccaagcccactgagcaaggcgagggattggacccatgtactcatggatactagtctggtttgttaaccactgagccactatggaaactccctattgacactattctgggccgaagtgcgggatccaagccgagtctgcaacctacaccacagctcacggcaacaccggatcgttaacccactgagcaagggcagggaccaaactggcaacctcatggttcctagtcggattcgttaactactgtgccatgacgggaactccctatatatcctttttaaggattaacaaacacaagggcccaagttttatctgtgaccagcctgaagaatgtgctgacagcagctataaaaatgtaaaaagtgtatactttgataggaccttacaattaggttaagattgcttttgctacttaatgttttgtttctatgataactagagttggagcatgcagtgacataatctatcttaatcagtgcatggaacttttaaaagaaaaatctttaaactgaaacaaagaaaaatatacccaactccattaaatgtctttagttgatatacatttcttactttcatgtaagtgtaattttatggtaaattcctttgaactttctatttttctaatttggtcttcagttacaaggaaattattcagttgacaaaaaatagtttctaaaatcttaatttcttctgtgtatcagtaattatttgacagtattcagatgatatggaaatgaattttgaaagtaacaacatgattatagaagtgaaagagtagggagttcccttgtggtgtagcaggttatggatccagtgttgtcactgcagcggctcgggtcattgctgtggtacaggtttgatctctgcccagggagcttccatatgctgtgggccaccccaccaccaccaccaaaaaaaaagaaagaggtgaaagagtaaaatcatagttgttaatagatacacccagcagtattacaggtttgctctttatactaatcagaaaagtgacagttgttgaataatagtttccttccatgacccttgttacttagggtgaagaatcactaaagtgaagcaaattgaactatttcctctaaatctttgaatctgaataggtttatataaaatacgaaacctattagatactcattttgaagttatgtggaatatgaactcttccttggattatcttcccctttgccctaatttgagtttccagtttccttagttactgaagagtggattttgctgtggtaaataaactgctaaaatgtgtttattatttgaaggagaaacaaataagcctacgtcttagggattctcttcccctcctccacacatgtattttaaagaaacagtctcaccttttagtagagaatgttgttatctttatcctaagaagtagcacttgtccttccttagaaatccagtttttaacttcatttaaaacactgccttttagaattcatatatttagttaggagggaaaatgactgttgtacatggttattagtaattgttttcattcttcagatatttatactttgtcgtcaccattattcctgagactttggaaaagaaaacaggtgatgagatgagtaattgggaggtcagatagaactgttacctagatctttcagaaaagcctttttgatgaagcgacattttagctgaggatataatgggtaacttttctctttcttgtagttccaagattatcccctaaaactcacagacccaggtctcccagacagaatagtattggaaatactcctagtgggccagttcttgcttctccccaagctggtgttattccaactgatgctgtccctatgcctttaccagctgcatctcctacgcctgccagtcctgcatccaacagagctgttaccccatccattgagggtatgtaagaaagggcttctagatccatgatgtcattggtgaaattgaattttagacatttaacattgtgtgaaaaatggttatgttgttttatccataggtaagtatttgatggcatattaaaaattttatgtaaataaagttagttgtttaagtaatactgctaatttcaggagttctcatcatggctcagcagtaatgaacacaactggtatccatgaggacacaagttcgatctctggcctttctcagtgggttaaggatctggtgttgctgtggctgtggcgttggctgccagctgcagctccaagtcaacccctggcctgggaacttcccatatgtagcaagtgtagcctgaaaagaacaataaaaataaaacctgctaatttcatatatgttattctgaaagtttaagagagtttacattcctgggtagtaaataacaatataagtaaaatttattagtggaatttcctggtggcctagcacttaaggattcggtgatgtggctcaggtttcttccctggcccaggaacttccatataccataggagcagcaaaaaaaaagaaaaaatatatttcatatgtctgcgaagtaggaaagtctctgtttaagtggaaatattcttttccaaaaacacaggatcaaatggttgagtattttccaattttacttctatagcttctattaacctttttatataaaatactgttttctagctaaagattccaggcttcaagatcagaggcagaactctcctgcaggaaataaagaaaatatgaagtccaatgagacatcacctagcttcccaaaagctgaaagtaaaggttagagctttaaaaagtctttaggtatatctgtagaaataggaaggaatatgtctaatctgatgcccagtacatattacttttttggtcaacactttaatttcttagtgttgtgatatttaagtgcataatttgacaaatgtcaaaatctataatatattgaaagttttgttattttggatagaggttatttttcatttccaccatcccatcctaaaaaaaatcttaaagattagaaataaatctaggagttgtcctgtagtacagtgaattgaggatccagtgctgtcactgcagcagcttgggttgctactatgacaccagtttgatccctggcctgggaacttccacatgctatgagcacagccaaaaaaattaaaaatagaaaaagaaatctagatctaatacttcatatttttacaggtatatcaccagttgtttctgaacatagaaaacagattgatgatttaaagaaatttaagaatgattttagggtaagtattgtattgactaatgaattagaatttttaaaacaattttttaaatattactaagaatttttatatcatccatttacaaaaatgtattttatatgtatacccagaaacatcaaaccatatttgtagaaagctaaatattcttaagttgtctgtgtgtgtgctttaggtagagtaactaaaatcatgagatttaataagaacaatatagctattaaatgaaagagaatgtaattttcatattggaagtcatcataagttattacttcatgttcatttgattactttattcaaatatgatagagcaaaggcaaaaggcagccttttcctagcctgtgttctaccttcctaaaaattaagtttttgcttgatagcttcatttttgacttattggcagtattcaaaatattaaatgttgtttcatactttagcacatttatctggtcatctttaatgctattaacagttgtgaatttaaatttttttaagctataattaatgcatggacatgataaaaagaataataactgaatgctcagatggttgctactcagcttacttaatatgtcaagcactctactatagttaaagtcctcctgggtacttgcccacctcagctacatccttctgtaggagtgaaggatttctttccttgtaattctttacactgcatataagtagattccctaagcaacagatgatattattttgcatcatcttcaacttaatataaatatgttacaggtgttcatgcccatttgcttttatttcctcaacattattttttacacccagtccttcatgcccttagagtaatacatttgcatgaatttattacattatgaaggaaaaaaattgtttttactttgaagcatataagatagaatgtttttgtaacagttttattgaggtataatttacatatggtttagtcatttaaagtatagtttagtggttttttagtatattcatagagttgtataagcaccacataagcccttagcagtcacttctcatttgctgtctttttttcttttttcttttcttttcttttttttgtcttttctgtctttagggccaaacccacggcaatatggaggtgcccaagctaggggcctaatcggagccaccggcctaaaccacagccacagcaacaccaggtctgagccgcgtctgcgacctacaccacagctcagggcaacgccaaatccttaccactgagcgaggctagggatcgaactctcaacctcatggttcctagtcagacagaactcctcatttgctttcaaatacttctccccaccccacctccaccctaagccaccactaatctactttttgtcttcatggatttggctgttctggacttttcatatgaaaggaaccatacaatatgtggccttttgtgggtggctttttttctacttactgttacgttttcagggtttatccatgttgttgggtgtgtcagtatttctttgctttttatgtgaactccattgtatagatagaccacgttttatatatccattcataatcagttgatgccttttccttcccccttacccctctggtaaccataagtttgttttctttgggggaggtgctatacctctggcgtatagaagttcccaggtaggggtccagtcgcagctgcagctgtcagcctacaccatagccacagcaacacagcatccaagccacgtctttgagctacaccacagctcacagcatctggttccttaacccactgaatgaggcctggaattgaacctgcatcctcaggggtactagttgcattgtttccgctgagccacaacaggaactcccaagtttgtttacttttttttttttttttttttttttgtcttttttcttgggccgctcctgcggcatatggaggttcccaggctaggggtcgaatcggaactgtagccactggcctacgccagagctacagcaacgcaggatccgagctgcatctgcaacctacaccacagctcacagcaacgccggatcgttaacccactgagcaagggcagggaccgaacccgcaacctcatgattcctagtcggattcgttaaccactgcgccacgacgggaactccccaagtttgttttctatgtctgttagtctatttctgttttgtaaatgagttcatttgtatcaatttttttagattctacatgtaagtgatatcatgtgatatttagctctttcttcatataataatctctaggtccatccatattgctgcaaacgacattctttcattcttttttatggctgagtaataatactgctgtatatgtgtaacacatcttccttatctgttcatctgtcagtggacatttaggttgcttccctgtcttggctattgtaaataatcctgctgtgaacattggggtgcatgtatattttataataagagttttttctaattatcttttgtggatatatgcccaggagtaggattgctggatacacggtaaatctgtttttagttttttaaggaaccttcatactgttttccacataggctgcaccagtgtatattctgagtagtttttttttgttggtggtagtggttttcattagttttttttttttaatgtagtgttagctggggtttcaaattcagtcttttgcatatgggtaacatttgccacagcactgtcttttgaaaagacattgaattatctttgcacctttgttgaaaatcatttggccaagtggaagagcttattactagactcggttctcgtccatagatctctatatatctatcctttatggcagtaccacactgtttgaattagtgtatttttttaaatgcttataacttcttcatttaaaagaaaacattttggctctcatattatctgttcacaactttctgtaaaccttctttaatacttgactcttaaattccaggtagttgcagcattatattgctatctctttgggacttctactcttaatattttgggggaacctgaaaatgcaaatgtattattaaatttcttatgaacagcttaatcatctgtaagtgaaataatagaaagcaacgaaatgatttgatttgatttgattgtcctttttttttggctttttagggccacactcgaagcatatggaagttcccaggctagggcttgaatcagagctacagctgctagccagcaccacagccacagcaactcgagatctgagctgtgtctgcgacctataacacagttcatgacagtaccggatcctcaacccactgagggaggccatgggtagaacccgcatccttgtggatactagtcagattgtttctactgcagcatagtgggaattcctgtctttattatttttgtttttttcgggctgcacctgcagcatatggaggttcccaggctaggggtcaaatcagagctatagctgccagcttactccagagccacagcaacaccagatctgagccatgtctgccacttaaaccacagctcacggcaacagtggatccttaacctactgagcaatgccagggatcaaacccacatcctcatggatactagtcaggttcgtttccactccgccacaacaggaactcctattttggttctttaaacatgcaatctctggtgttccagctgtggtaaaatgggttaatgatctggcttgtctctgaggaggcactggtttgatccctggccccggcacagtgggttaagaatccagaatcctgcagctgtggtgtagttcacagctctggcttggattcgatccttggccctggaacttccatatgctcatggacagccaagaaagaataaaacaacaaaaaacatgctgtttcttttgcttgcactagtattcctgttttggaactccacacctgccttcctccctcaacatctttcacactttaaactatatgacacttccaaagaaaagccttctctttccataaattgctttttcctacggcatcttttagcactaccccagttgttgtttgtctattctcatccagatggtaaactttgggaggataggaactatttcgcatttctatgtcctacatacagaatttctgacacatggtatgcactccgtaattttttttttaggctaggacatttgcgtgcttacatgactagttactgtgtatagacatactgttattgttgccttataatgaaaacattattcataaagtatgaaaaaagcttttagtatactcatgcctacaaatactagttttgctcatggaacaaattgattactagactaatttaaaatatttaagtataattatttcctttatttagttacagccaagttctgcttctgaatctgtggatcaactgctaaacaaaagtagagagggagaaaaatcaagagatgtgatcaaagacaaaattgaaccaaatgctaaggattctttcattgaaaatagcagcaactgcaccagtggcagcagcaagccgagcagccccagcatttccccttcaatcctcagtaacacggagcacaagagaggacctgaggtcacatctcagggggttcaaacttccagtccagggtgtaaacaagagaaagatgataaagaggagacgaaagatgcagctgagtgagtaaacctggaatttagcacatccttcattattttttcgtagggtgtccagagccttccaactctagaatttgtctagacttttagactgctttataagtagccctcaatttataactaactggcaatgagatcttaagtaaattaggtcattgcaccctatacttttcttctgtccactgcttttgcactccatggcacaaaaaatcctatgcatacattaagaatggcttttttggtaaatatacaaataattgaaaaattactggtttttggaaagcttccactgtggtacaggttctgtcctggcccagaaacttctgcatgccatgggtgcagcaaaaaaaaaattactggtttttgggaccaatatcccttagatgctggtcagtacccaccttttggctgtgctgctaggactaagaactgtcgctagaagtacctagtgcccctacttggaatttattgtattttccaccagaaacaatgttctaggagttcgcgttgtggctcagcagttaatgaaccctactagtatccatgaggccttgggttcagtccctggccttgctcagtgtgttaaggatccagcgttgccatgagctgtggtgtaggtcgaagacgtggctcggatcccaagttgctgtggctgtggtaaaggctggtggctatagtgctgattcgacccctagccttggaacttccatatgctgccattgtggccctaaaaagaaaaacagacaaacaaacaaacggtgttttagttaatggttggatttgttaagacagaattcattctgacacctgaacctaacccaacattgtaaatcaactaaacttcatttgaaagaaaaagaaaaaaagatggaattaattctgtacatccaatatattgccagttaaatgggcttttgtgagctagccttagaacctaattacgcacaatctatttatttgttctggctccatacaacccagttatagctgaacttttggaatgcaccttgttgataagtagggagaattttttcttgacttgaggcaaaaatttttattgaattcatgatttttcccaagatatttcatgtaggaaacactttgtcaaataaaaaaagtattgcatgttttataattggtatattaaggattgcttttaaggattttttgtaaggggctactgtcttttctgtttaaattcttgttgattgcctttgagataagttttgcatattacactttataaaaattttgttctttttttgactagttatcaaattaaagagaagtacgtgtatgtgtatgtgtttcatgaaggaaactaatgatcttctagtgagaattgcttagatgtttagcagttaagaaaaaaaactgtcaggtataaaagactagagaagcataaattccttgcagatttcactggcctttatttttttcttctggtataggcaagtgaggaaatcaacattgaatcccaacgcgaaggagttcaaccctcgttccttttctcaggtaagtttctctctctctttgaagtaatctagttttttaaaaaattattattactccttttcccacacctgccatctaaattcagttatagtatgctaaaacaactactagtttcttatgtagcaattaatgaatatttttgagccatagaaaaaaattcctagttttgtcatcaattagatatgatctaggtcaaatctttgaatcctttctgattcaaaatttgaagatgattggcttactaggttctcaggttcatagatgatactgttattattctcctgactttgtaagaagataaggtttatttttaattttttaaaatactttctccagaagttcctgttgtggctcagtggttaacgaatccgactaggaaccttgagattgcgggttcagtccttggccttgctcagtgggttaaggatccagcattgccatgagctgtggtgtaggtcgcagacgaggctcggatcccgagttgctgtggctctggtgtaggctggcggctacagctccaattcgacccctagcctgggaccctccgtatgctgcgggagtggcccaaaaaatgacaaaaagacggggaaaaataaataaataaaactttctccagctgcttaaaaatcacctctgctgtttttaatagtattgttgattaaagttaacattaacttgctacgagcatatttttttctttaacttgaaacacatggaagtttattttctattaggtattttcattaagagggcctaattaaaagtgagtaaaactaagaaagatggggggagttcccatcatggctcaatggtaacaaacctgactagtatccatgaggacccaggttcgatttctggcctctctcattgggttaaggatccggcattgttatgagctgtggtgtaggtagcagacacggctcggatcccaccttgctgtaactgtggcgtaggccggcaggtgcagctccagtactctagcctgggaacttccaaatgccatggatgtggccctaaaaagacaaaataaaataaatattaaactgaaaaaagataggggtagttagtcttcagattgcaataatagttagcttttcatttaagatagttgatttttgtttttgtagccaaagccttctaccaccccaacctcacctcgtcctcaagcacaacctagcccatctatggtgggtcatcagcagccaactccagtttatactcaacctgtttgttttgcaccaaatatgatgtatccagtcccagtgagcccaggtgtgcaagtaagtcatagaatttgttcatttaccctctctaagctatttgtatgtgacaccaagtattccgaaggtgtgcagtgacttgaggtagtgatggtacaacagaggtatttaaaaagtgaaggcttggagttcccattgtggctcagtgggttacaaacctgatattgtctctgtgaggatttgggttctacccctagcttcacgcagtgggccaaggatccagccacaagctatgtcgtagatcccagatgcagcttggatcttgtgctgccatggctgtgggtatcacctcagctacagctctgattcaacccttagtctgggaacttccatatgccgcaggtacagccgttttttttttaaaaaaaaaaaaaaaggcttgcagtgtggtgtattgttaatataaggacctaagtctgagactattttctggtaaaaaagatggtttatattttttgtagtttgggcttttctttttaactgtgggtgtgatttcattttttaatgactcatagagaatcaggacatctcagaggtggctctcaagcaatgtgcgactaagagtggtaagataaattcttaatatcttgagagcctaatcgtcttttttttttaattccctcaagcctttatatcctatacctatgacgcccatgccagtgaatcaagccaagacatatagagcaggtaaaggtgagaataatcctgcctgtgtatgcttataatctgcatgctgcatgcattaaataactcaatttataatgaataaatatttgtggtgcagtttgactttaatgaagccgttcattgacttttgatgcctagaatattacatcagatacttagatgtgtttttttatgagcaaaaacagggaaggagaaatacttatgagttgggaatattaggtatcctcttcacaaagaataatttctttttgatgtcttcagtgttaaatttgaaaagagggtttgctaaattgatttactcattcctgatattttatatgacatataatttttccccaaatttaaaatttctttttgagtaaacagcagctcatttcagaaaacatcaaaatgctgtttagagggatgtttcctcatctttaaagtgagagcgttgtataatctagtattctttatttgtgtacaagagccttcataggaaaaaacatgtatttatcttgaggaaatcttttttttttttggtcttttttaggactgcacccacagcatatggaggttcccaggctaggggtagagtcggagatgtagccaccagcctccaccatagccacagcaacgagggatctgagtttgtctgcaacctatactacagctcatggcaacactggatccttaacccactgagtgaggccagggatcaaacttgcatcttcatggatactagtctgattcgttaccactgagccatgatgggaactccttaagaggaaatcttttaatgttgagtaatgctaaagtattaccctttttgccatttaagtaattgagagcaattatttgctgtcattttattgagagtagagtgtagggtggcttatataataaggttatttctcaagcccaataattgtcttcctgacacaaaaatttcacccttttatttttatttccattgtagtttattatagaatactgagtatagtttcctgtgctgtacagtgggattttgttgtttatctgtttcatatatcctagtttgtgactgctaatcccaaactcctagttatctctcccgcatccccttaacttttggtaaccataaatttattttctatgtctgtgagtctgtttgtttgaaaataagttcatttgtgtcatttttcagacacctcatataaatgatatcatgtgtttgtctttctctgacatcactgttagtatgataatatttagttccagccatgttgctataaatggcattcttttttagggctgagtagtattcgtgtgtatgtgtatgtgtgtacgtgtacacacctgtgtacacacgctgtacctttacccattcatccgtcagtggatagttaagttgtttccatatcttggctatcataaataatgctctggagttcccgtcatggcgcagtggttaaggaatccgactaggaaccatgaggttgcgggttcggtccctgcccttgctcagtgggttaatgatccggcgttgccgtgacctgtggtgtaggttgcagacgtggctctggcgtaggccggcggctacagctccaattcgacccctagcctgggaacctccatatgccgtgggagctgcccaagaaatagcaaaaagaccaaaaataataataataataatgcttctgtgaacattggaatgcatgtatctttttgaattagagttttcgccatataaatggcctagaagtaagattgccagatcatgtggtaactctaaaaaaatttcaattgttaaattaataagctttcctcagtgtttgaagtaattgttattttgtggatgttaataatgaaaacttaaaaaaaaaagttgtatgaggagtttactctgtggcacagtggtttaatgatacaccttggctttggaggcactagcttgatccccagtctggcacagtgggttaaagatctggtgttgctgtagctgtggcataggttacagctcttgcttggatttgatccctgcccaggaacttccatgtgccgcaggtacagtgaaaaaagaaaaaaacagaactttttttttttttttttataaggaccgcacccacagcatatggacgttcccaggctaggggtcaaatcagagctgtagctgctggcctataccacagctcatggcaatgccggatccttaacccactgagtgaggccaggaatcgaacctgccacctcatggatactagtcagattcgtttccactgagccacaaggggaactccaaaacctgtatggtattctttatctttgccttataacactaaatgaaagaactctaaatcatttaaagttatctagttacaaggttaatttttttctaaggacgtgccatttcatttctacatacttaatgagtatcttttaaaagcatggacatttttactaggcagccagagtgttgttatcacactttataaaataagcagtgattcctttttatcatctaataattatcataatcaattattcctgattgagccaagaatatatttttatagttggtttattttgagtatggatcaaaacaaggtgtgtgcattatttgttacatgtcttttagttcccctgctattgctttgtggcagaaaccagttgttatatagcatgtcctgtgttctagatttgtctccttatttctttttcttttttttttttttttgtctttttgctgtttcttgggccactcccacggcatatggaggttcccaggctaggggttgaatcggagctgtagccaccggcctacgccagagccacagcaacgcaggatccgagccgcgtctgcaacctacaccacagctcacggcaacgccagatcgttaacccactgagcaagggcagggaccgaacctgcaacctcatggttcctagtcggattccttaaccactgcgccacgacgggaactcctgtctctttatttcttaagatgtcattgattgcattcaggtttaacttttttgtgggaagagataggaatacttcatagatatttgtgagtgctctatattggatcattcaagaggtgtatagaagttcctcctgtgggttaagtgggttaagaatcccagtgcagaggcttgggtctctgtagaggcacaggttcaatccctagcccgacacagtgggttaaagggcccagcattgctccaggtgtaggtcaagttcagttcctggcccaggaacttccatatgcagaggtgtggccataaaagggggaaagggctaaaattaaaatttaagaaaggtgtgcaatatctgatcctactttaagttatggtaagattcattaagggctcagatagtgatagcctgatcctccccctctctagttgtagttttatgttcctctttcatctgattcattgatgattgatccttaacatcgtcttttcattagggcagtggttctcaaattttagtgtatattaatttcacttggaaagtttgttaaaaatacagattgcttggtcccatccttagagtttccaatttagtgggtttgtggcatagcctgagaatttacttttctagtgcaatttataaaaacccaattccctagtaatgctgctggtagaagactatagtttgaaaatcactgtagttaggagtttaaaagagtgatttctgaatttctagcatttcttctccatttattagttagaatcattctgtaaagggctatttttttctttttcttttcttttcttttttttttttttttggtctttttgctgtttcttgggccgctcctgcagcatatggaggttcccaggctaggggtcaaatcggagctgtagcctccagcctatgccagagccacagcaacatgggatccgagccgcatctgcaacctacaccacagctcacggcaacgccggatcattaacccactgagcaagggcagggaccgaacccgcaacctcatggttcctagtcggattccttaaccactgcaccacgacggaaactccagggctatttttttcaacaagggcagtttgggtatcctgaaatagtttatacaggagagtgatgaacacatgggttttcatgtagttttatattgattgtgtttcagtcaattattatttttcctgctcccgttgttccaactttgatcaatggtagtcccttcaagatgggttctttgtccttttgatactacttatttatagacccgatcagtagtcctccaagcaatcctgattctttttgctgagaaatagtatttagaaaccaggagttcccattgggagttcccaactagtatccatgagctccaatttgacccttagtctgggaacttccgtatgccataggtatggccataaaagaaaaagaaaataaaaaaaaaagaatccactttctggtcattggatatgctcatatgctcattgctattgacttattatctgttttttaacaaattgccacaaatcttagctgcctaaaacaacaaacattttatttcacatagtttccgagggtcagaaatccaggagcagctttgctgagtggttctgccttagagtctcttaagaagttgcagactggagttcctgtcgtggcgcagtggttaacgaatccgactaggaaccatgaggttgcgggttcggtccctgcccttgctcagtgggttaacgatctggcgttgccgtgagctgtggtgtaggttgcagatgcggctcggatcccatgttgctgtggctctggtgtaggccggagactacagctccgattcaacccctagcctgggaacctccatatgccgtgggagcggcccaagaaatagcaaaaagacaaaaaaaaaaaaaaaaaaaaaagaagaagttgcagacaagttgttggctaaagtggtggttatctgaactagggctggtggatctgcttcccgactgagagccgttggcagaataattctggtcataacatggcagctggcttctcccaaaatgactattcagagagaaactgacttaaatgtgagttgcagtttgtaaacctaacctggaagtgacatatccttacttttgtcatttgctgtacacatggtgcctgtgactggagactacaatatgggttgtgaataccaggaggcaggatcattgggggctatcttagcagctggcttatttagtataatgtgtctaagatgttttaaaagtatttcttctctgttagacttcagaataaaatataagatttctttggagtgttacttttctctagcatctgtttcactaagaattccttaagtgtcagttttcattcaggagttgctaccttttttttacttccataatactgtcttctatatagtcactgagttaagtcagcaatttgacacacaggtaggttaatcgagtttgttatcatttgtaaggatagtttttttttaattatttcaattttattttatttatttatttatttattttgtctttttttagggctgtacccacagcttatggaggttcccaggctaggagtcgaatctgagctgtagctgccggcctataccacagcaactcaggatctgagccacatctgtgacctacaccacagctcacagcaatgccggatccttaacccactgagcaaggccagggatcaaacccgcaacctcatggttcctagtcggattcgtttccactgcaccatgacgggaactcctcaattttatttttatgtgtaaaatattaatatattttcaaatggaaattacataaaaagattatacggggagttcccgtcatggctcagtggttaataatcctgactaatatccatgaggatgtggttttgatccctggccttgctcagtgggtaaggctccagcattgctatgagctgtggtgtaggtcgaagacacggcttggacctggcattgctgtggctgtggcattggccatcggctacatctctgattcgacccctagcctgggaacctccataaaaagaaaaagacaaaaaaaaaaaaaaaaattattcagcaaagtattactttgatccgagtttcttccatttgtacttgacctcatcacttccaccccagtatgtggatggccccttacatcattagcagctgatcattttaaattattttctagagttccctgatggcctagtggttaaggacctggctttgtcactgctgtggtgcaggtttgatccctggcctgggaacttccacatgttgtggatatggacacctccccaaattattttctatccatccttaaaatatttattttctggagttcctgtcgtggcacagtggttaacgaatccgactaggaaccatgaggttgcgggttcggtccctgcccttgctcagtgggttaacgatccagcgttgccgtgagctgtggtgtaggttgcagacggggctcggatcccgcgttgctgtggctctggtgtaggccggtggctacagctccgattcgacccctagcctgggaacctccatatgccgcgggagcggccccaaagaaatagcaaaaagacaaaaaaaataaaaaataaaaaaaaatcaatttattttctaagtatatatttctaagtatatatttgtttctttgcagatatgcattcttttttttctaatagctctatttagatacacagttgatctttgaatggcttgggttaggggcattgacccttttgtgcagttgaaaatctgcttataatttatagtcattcctccatatcctcagttccagatcagtgaacattggatcttttttggctgtattattgactattagaaaagatctgcagggagttcccattgtggctcagtggaaatgaacctgattagtatccatgaggatgcgggttcaatccctggccctgctcaagtgggttaaggatctggtgttgccgtgagctttagcgtaggtcacagatgtggctcagatctggtgctgctgtagctgtggagtaggccagcagctgtagcttcgatttgacccctagcctgggaacttccatatgccttgggtgcagcccaaaaaagcagaattaaaaaaagaaagaaaaagatttgcatataagatgatccgcacagttcaaagttgaattgttcaaagatcacctataattgaaatgccgtaagattcatccatttgaagtatatggcttggtaggttttaggatagtcccagaggtcagtcattaccacagtcaatctaaaaaattttatcactccaaaaagaaaccttgtattaataattactcccttcccgccccatgcacatatacactcacaccctagacatgttaatctactttcttttctctataatttacctgttttggatatttcatagggatgaaatcatactctatgtagtctttgttgactggcttttttctcttagcataatgttttcaagtttcatctatgttggagtacctgtcagtacttcattccttttatggaattgtataaaccccacattttatttatccattcatcagttgatacttctttgggttgttcccattttctgactagtatgaatagtgctgaacattagtgtacagttttgtgtggatttactatgttttcatttctcttggagtggaattactttgttggaattgccacactgttttccaaagtgactgtccctttttatattcttaccagtagtgttcaaggtcccaatttctctacatccttactaacaattgttattgtctattatcctagtgaagataaaaatagcacctcattatggttttgatttgtatttctctggagattgatgatgttaagaatcttttgatgtgcttgtcaatcatttgcatatcttctctggagaatagtttattcaaatatttgatctagtttttaattaagttgtttatttattatttttatttttatttatttttatttttttagggccatacccacagcatatggaagttctcaggttaggggtcaaatgagagctacagctgccagcctacaccacagctcatagtaacaccggatccctgactcagtgagtggaggccagggatcaaacccgcatcctcatgaacattagtcaggttcgttactgctgagccaagttccaatgggaactccaagttctttctttcttttttttttttttttcttcttttttctttttgattttcagggctgcacctgtggtctgtggaggttcccaggctaggggtcgaattggagccacagctgctagcccatgccacagccacagcaatgccagatccttaaccgcctgagcgaggccagggatggaacccaaaacctcatggttcctagtaagattcgtatctgctgtgccacagcaggaactccaggttatttatttcttaatcacagggctgtaagagttctttgcatattctatatataaatcctttatcagatataggacccacagatattttctccattttatgggttgtctttttacttgcctgatggtgttctttgcagcacggaagtttttacttctgatggaagtttgatttgttcttttgttttttgttttttgttgttgttttcttcgtctttttaggactgcaccttcggcacatggaggttcgtaggctagggttcaaattggagttgagctgtagttgctggcctcaaccacagccacagcaactccagatctgaggctcgtctgcaacctacaccacagttcacgacatcagatccttaacccactgagcacggccagacattgaacccaagtcctcatggatactagctgggtttgttaccactgagccacagtgggaactcctattttatttttgattttgcttttgatgtcacgtctgagaatccatttcctaactcaaggtcagaaagatttgctatgatttcttaagagagtttgctgtgatttctttcagagttcagctctaacatttaggttggtggcacattctcaggtaaattctgtgtatagtatgaggataggattcacatttttttgcatgtggatattcagttattccagtaccatttggtgaaaagaccattcttttttcattgaattgtcttggcatccttactgactttatatttttcccctcatacaaaaaaggaagcacatcatatgtactgttctgcactcatgggattttggtttgaagacctcctgtttcctcagaagtgctatatatcaatatatcaagattttcctcatttctttctagtggcctgagccacagcagtgacaacactggatcccccacctgctaggccaccagggaactccaccccactatttttttattaaattgtttatcttattgagtgagaggaatataggtggatacaagtctttttctatatttcaaatattttcctgtagcctgtggcttattattcttttttcttttttttttttttttggtctttttttttttttttgtctttttggcatttcttgggctgctcccgcggcctatggaggttcccaggctaggggtccaatcagagctgtagccgctggcctacgccacagccacagcaacgtgggatccaagccgcgtcttcgaccttcaccacagctcacagcaacactggatccttaacccactgagtgaggccaaggatcgaatccgcaacctcatggttcctagttggattcgttgatggctgagccacgacgggaactccttattattcattttttaaaaatttatttgaaagagtcattttcagttttggagaccatatggtcaattatggttgtgtgttttttttcctatattaacatacttgaaggttgcaaagattcactcctagaagttttatggttttctcctgagttttgccttttgattttttgattcatggttttaaagattttgcccactcatgtttaataaaataaatcatatgccttctacaatttatataacttctccttttttacatttaaatttatgactcgggagttcctcttgtggcccatcaggttaagaatcctgcaggagttcccgtcatagcacaggggaaacaaatccaactaagaaccatgaggttacgagttcagtcccaggcctccctcagtgggttaaggatccggtgttgccgtgacctgtggtgtaggttgcaaatgcaactgggatctggcattgctgtggctcttgggtagggcggcagctgtagctccgattagacgcttagcctgggaaactccatatgccgcaagtgcaattcttataagacaaaagattaaaaaagaagaagaaccctacatagtatctgtgaggatgcaggtttgacctctaggctcattcattgggacccttagtcccacgttgccacaggtcgcagatgctgcttgaatacagagttggctgtgactgtagcataggttggtggctgtagctccatttcgacccctaggtctgggaacttccatatgctgcaggtatagccataaaaagatttttaaaaaatgctcatttggaaattattttatatacagtgtagagcataaatctagtttatcttgttccaaatggctatccaaaattttttttttttttgtctttttgccatttcttgggccgctcccgcggcatatggaggttcccaggctaggggttgaattggagctgtagctgccagcctacgccagagccacagcaatgcgggatccgagccgcgtctgcgacctacaccacagctcacggcaatgccggatcgttaacccactgagcaagggcagggatcgaacctgcaacctcatggttcctagtcggattcgttaaccactgcgccacgacgggaactcctatccaaaaatttttaacccattatattattctgtaatttagtacaacaaaatatgtttatttaggagttcttctgtggtgcagtaggttaaggatctggttttgtcacttcagtggcttgggtggctgctgtggcataggttcaatccctggccggggaacttcacatgctgcaggtgcagcaaaaaaaaaaaaaaggaaagaaagaagtgtgtttaagtgtacattttgatgaaaactctgctccactaccacgcactccaggcaaccattgatctgctctctcacactttttttttttttttttttggtcattcctgaggcatgtagaagttcctgggccaaggattgaacccaagccactgcagtgacaatgcttttcaaggctgcacctgtggcatatagaatttcttgaggtaggggtcaaattggaattacacctgccagcctataccacagcaaaactggatctgagccacatctttgacctacactgtatcttctggcaacgctgagttcttaacccaccaagtgaggccagagatcaaacctggatccttatggagactatgttggttccttaactcactgaaccatggtgggaactctcccctcccccccattaattggtttttgaatattgaaacagccttgctttcctggtatcctatttatacacttagttgtagtgtataatctttatatgacttgatctgatagtattttattaaagaggtttttgtctgtggtcatgggaaatactggtctgtagtttgtgttgctttgtaatgttttataaaattttgataccaagttaatactggttgtctaattttccaaatttaacggtttaaggttgttgataatattcctttatctttttaatgtctttaggatctatgctgatctatactcctcgtattgataatttatgtctttttcttcttttttattgatcagtctttctagtgacttatcaattttcaaaggacaacttctactttcattgattctttatcatttcctttcttttgccttcttgtgtgtgtgtggcggggggtgtgctttttagggctacacctgtgtcatatggaagttcccaggctaggggttgaatacaagctgcagctgcccgctgcagccacagtgatacagggtctgagccatgtctgtgacgctgcaccacagctcatggcaacgctggatcactgacccactgagcaagaccagggattgaacccacatcctcatggatacttgttagattcatttccacaacagaaactcctcttttgccttctttaatttgctgttctttttctagtttcctaaggcaattgcttaggtcattgagtttaaaactttctttttttctagggagtttccgttgtggcttattgataacgaaccccacttgtatccatgaggatacgggttcaatccctggcctcgctcagtgggttaaggattcagctttgctgtgagctgtggtgtaggccagcagctacagctctgattcaacccctagcctaggaacttccaaatgctgtgggtgcggcccttttaaaaaaaaaaaaaaaaagtcaaaactttcttttctaggagttcctgtcatggctcagtggttaatgaatctgactaggaaccatgaggttgcaggttcggtccctggccttgctcagtgggttaaggatctggcgttgccgtgagctgtggtgtaggttgcagatgtggctcagatcccgagttgctgtggctctggcataggccggcggctacagctccgataaattagccccctagcctgggaacctccatatgccgcaggtgcagccctagaaaagccaaaaaagaacacaactttcttttctaatagaagcattttaaagctgtagatttctaattactgctttagctaaatccctgaaacttgacgttgtatattcatattttattcagaatattttctgtcttatgatttcttctttgaccaatggtttatttagtagtatgtttttttagtttccaaatatttgggtatttccaaatgtatttctctttttgatttttttcattccattatgatcagagaacacactgatgtgaaatgacgttttcgtcatatattatgtccacgtatctctatatttggattttctcttctgtcctgttttagctatctgataagactactttcccatccatccactcctgacttttgattttttttctcccctcaggttttcttgacttctttcttttttctttctttttcttttttttgtcttttgtccttcttttagggccgtacccatggcatatggaggttcccaggctagaggtccaatcggagctgcagctgccggcctacaccacggccacagcaacttgggatccgagcctcatttatgacttacaccatagttcatggcaacgccagatccttaacccaagtgaggccaaggattgaaccctcatcctcatggatattagtcaggttcgttaccgctgagccacaatgggaattcctttttttttattgttaatgtaaactatttgcatcttttccattgcttcttcccattagttacttaagacataaatttattgcatactatttgttctcttcatgttaatgttatatcctgctactttgctctgtcaaatgacagaggaaatcaaggacatgcttcagaaatgcagccatagatcatatctttcccgcatgaaatagtagggcccttctgcacagagacagcctctttgtcttcttggcacataatgtagtcattgtttattgcatcctgtgagaaaaagtgagtttgtgtttgaaaatgtgctgaagtcaagaatattttgggacagatattctttggcggagtggaggtagggagtgtcctatgcattatagactttttattagcatccctggcctctacccattagatggtagtaataaccttcatttccctaattgtgacaaccccaaatttttccagacgttgtcaaatgccccttgaaaggcaaaattgcacctagttaaaaatcattgacataaagaaatggctaaggtatggctcatgtaaagactaggtagattgggagttccattgtggcacagcagaaaacaaatctgactagtatccatgaggatgcaggtttgattcctggtctcgctcagtgtgtcagagatccattgttgctgtgagctatggtgtaggtcacagacacggctcagatctggcgtcgctgcagctgtggtgtaggccagcagctgcagctccaattcagcccttagtctgggaactttcatatggcatgggtgcagggctaaaaagtgatcacactgtcatccttaaggatactagccaagttcgttatcactgagccacaatgggaacttcctaactaggatttttttttttaatttaaaaaaagtagcaggcgttcctgttgtggctcaatggattaagaacccacctggtatctatgaggatttgggttcaatcccagacctcactcagtggcttaaggatccggcattgctgcagactgtggtgtaggtcacagatgcatctcggatccagtgtagctatggctgtggcataggctggcagctacagctccaattcagcccctagcttggaaacttccttatgtcacaggtgcagccctaaaaagaaaaaagtaaccttaactggttttttgaaaaaaaaaaaaaaatttaatgtgtgagggttataaatcaagcatctaaagaaatagtgaatgagtgaagctcatttagcttaattaagcaaacctctgataaaaatgaaaaaatgttattagagtttggagtggctttttttggaggggtgcacacctgcggtatatgaaagttcccagtcgaggggtcagattggagcttcacctgctggcctgtgctataggatctaagccatgtccatgacctacgctacagctcttagcaacaccagatccttaacccactgagcggggccagggatcaaacccacatcctcattgaatattagttgggtttgttactgctgagccatatcgggaactccctggagtggctttttttcactaaacaggatgccttctcaatatgtgggaactcaagattaaattaggaaaaaatattactgtgtttgtttcctttgttttcaggtttgctcttgtaactagttaaaacagtatataactagctatcctaaatgtcagcaacagtcattaaaaatttttagcaaaaaggagttcccctgtggctcagtggtaacaaatctgacttaatatccatgaggacgcagccttgctcagtgggttaaggatccggcgttgctgtgagctatggtgtaggtcacagatgcagtttggatctgctgttgctgtggctctggtgtaggccagcagctgtagctccagttggagccctggcctgggaacctccgtatggtgtgaatgtagccctaacaagcaaaaaataatgataataataatgaaaaccaaattatatctctactttagcagtttcttgtatagtcggttctgttggttttgtgaatgtactttgtgcctcatatcttctggaagcaatggttgacagtttctttccttaagtggcttagttaacatagcatgtcaacccatcacaaacagcagtcagtgctatggtaaacatgtgagtaaaaggtacacagagcattcagctagctttttgtaggcggctagaaaacatgttacagaggagatgatagttgagctaaattcttaactagagctctaatgaggaccataggcagaaatttgtgtggaataatagaagacataaagtggagttcccgttgtggcactgcggaaatgaatccgactaggaactattgagtttattgggttcgatccctggcctcactcagtgggttaaggatccaacgttgccatgagctgtggtatagattgcagattccactaggatctggtgttgctgtggctgtggcataggccagcagctatagctccaattcaacccctagcctgggaagctccataggccacgggtgcagccctaaaaatcaaaaagaaaaaaaaaaataataaaagacacagtgtcattttttttaagactattaatttagaaacatgctacatgatagcatgtgatgctgtttggggaaagagcaagacatataggaattcagtggcggaaaattttaaaagatggatttaagattagtgttggatcagagtttccatcatggctcagcagaaatgaatctgactagtgtccatgaggacacaggtttgattcctggcctcactcagttcatcagagatccagtgttgctgtgagctgtggtgtaggttgcagatacggctccgatctggtgtggctgtggctgtggtgtaggccagcggctacatctccattcaacccctagcctgggaacctccatatgccacaggtacaatttaaggcaaaaaaaagaaaaaaaaaaattagcattggatctattctgtttttttttttttttgtactttagtttttctttgaataaattctatgcccttctagcatgtagaataatttagtatattaaacagggattttcctcagaagtgtgagggaaatgttattttcatagtcttatagttacagggacttgatcaaatctgggggcagtcatggaggatatctctgaggatgttgctttcaagccgacgcttgaaggacagttcaaaattttcctacctgagaatagggggttggggtttgaggctgcggaatgaacatatgtgataggaaaatagcccagaatggctgaaggtggggggggggtggtataacggcattggagaggtaggcagaagagtcaaatcattcagagcccagtggaccatgttcatgtattttatgctagggagatgttattttctaatattaagctgtctttttctgcagtaccaaatataccccaacaacggcaagaccagcatcatcagagcaccatgatgcatccagcctcagcagcaggtccaccaattgttgccaccccaccagcttattccacacaatatgttgcctatagtcctcagcagtttccaaatcaacctcttgttcagcatgtgccacattatcagtctcaggtaagcctaatttgacctaataactcttgttattccacttaaataacttttaatatggtaaagagggtttctttttttattttgatctatgtgttaatggtgaggtagacagctaaggatttgggggccctttttcataatgtgttagaaagttgctgatcaatgtaagtgtttaaaagaaaatagtcaagaaaggatttagaagttccaaacttgtttctgaaaacccagagttaagacatctaactaaatgtacttgactttattttatactttaaccttttttctttttcttttttgtttgaacacagcatcctcatgtctatagtcctgtaatacagggtaatgctagaatgatggcaccaccaacacatgcccagcctggtttagtatcttcttcagcaactcagtacggggctcatgagcagacacatgcgatgtatggtaggaagcactttgtttgtctttttcagtgtgtatgattctttttaatatgtttttaagctctgaaagatactgtgtttaagaatcagtctgctggagttcctgctgtggcgcagtggaatctgtggcttctctgaaacactgggaacacaggtctgataccttgcccagtgtgggcaactccacatgccatggtatagccaaaaggaaaaaggcaaaaaaaagaataactctgcccccccccccttttttttctttttagagccacactcacagcataatgaggttcccaggctgggggtcatatctgagctacagctgcccacctacacgacagccacagcaatgtgggatttgagcctcatctgcagcctacaccacagcttacagcaatgctggattcttaacccactgagtgaggccagggatcaaacctttgtcctcatggatactagttaggatttttttaggatcaaacccttgtcctcatgaatactagttgtgttttttatccctgagccacgataggaactccaactctgccttttatgacattgagtgtcaagaatctaaaacaacaacaaaaaaaatttctctctgatgtgctctgtaagtcttgtcaaatcatttctacttctgttctttaaattcctctgtcttcaaatgtctctctcactaaaatgtaacagaaagcatcttttgtagagaaagaagtctttctcatcagtaataacatttggtattcccttcctaaggcatgcaaggaagttttaacataatgaaagctctctagaaaaacattctacttcgctccttggtctggattacacaatatatataagggtaataagctgaaattactgtcttaattttctggccagagaactttgtgttggtcagcttttcagttgtctaaagtactaaaacaatgttttattttaattaatgttttcagtgttgagattgtaaaataagatttccacttatatcttgtaatatagattgtttttttcctttttggtcaagcccacagcatacataaattcccggaccaggggtcgaacctacgccacagcagtgacaatgtcagatccttaacctactgcacctctggggaactccctcttctaatatagaattaataggttatcccatgttatgtttttcaaagggcacctttaattactaccagttttattaagatctaaattttgttttgaacttttccagttggcattttggttttaactttagataacagtttataacatttcataagttcatgacaggcagcaacagttatccttgtcacctgtaattcatcgctaatgctttctttctatagagtcatgccgttgtcccactggtttactaatggtaggaattttgcatgactaaaagcattatttttataaaatatttaagtcagatcttagttttccacacttcaaattttctaatgtggattattgctctttaaattaaaatgatgtaattgctacatttggggaaacatttcttccaagaagcccttccataatttaattgaaagattgtcagactgatctagcttattcttttgtttatgatcttttatcattggcttctctttagttttctaaaccaggactaagtatgtgtgaaaaggcatcactgacttatcacacttaacttttatgcagtttgtatatatttcactaattttccggtttgctaaaaccttagttgaaaagttcattatgagtgtttatacatagatttctgaatacatcatgatgtaacaagtggaaaaaacacttctttcttccaatttttctggcatactgcccttggaaataagatctgaaactttttgagcttaaatttccattgcttttagagaaagctatttgtgtgcccatgcctttgagacattgtagtgatactgtgatgttgagcagaatctttcttcatgtattcactcactgccaacatctggctttgtcttttggatggatattcactgaaatagcctgtacagtaaatactatatttgaggcactaatggtttttaaaactgcctccccagaatattcccatttaaaaaagcagttggctttagaccctcaaaagtccattcaggtgtaggtaagtaggagatattgcaaataaaattctagacctgatttcaagtgaaatctagaatgaactagttatcaaagccagttctttgatgccaggagaaagttgctcaaccagatctgaactactctcctgcagtttacacagattgtatttaattggtgtctgttgttgagggcgggctagggacaaagctatggatttggtatgattcttgcttgttctctttttggagaacatcataccctgaaaagaacactagaaaatgaattattttgttcttgccacaataagccataatttaatctcctatagcaagttcattaattcttcagtaatttatttcacttactagatcttccaaatctaattacaccaagcatggacgcattttaaactgtaaggcaaaacttgcatagaaatgctgattttatactcatttcctttgaacagtttatgttaccaaaggaatcaatattttgagtgtcaattatttttaagctacattccatatgtattttttaaactttttatggaaacagaagaatgtgggagttcccattgtggctcaccaaaacgaatcttactagcattcgtgaggattcaggtttaattcctggccttgctcaagagggttaaggatccggcattgctgtgagctgtggtataggttgcagatgcagcttggatcctgcattgctgtggctgtggtgtaggccagtagctacagctccaattcgacccctagcctgggaacttccatatgccgtgggttgcagctgtaaaaaaacaaaaaagaaaaaaacagaagaacgtgcatccagatagtaatgactattgtatgtcacctttttgtcattcattgttatggccatagcaaaagcctttgaaatgactgtaaaataaaatgttgagtatcatttttaaagtttttggtatatttactataaatattctaacaaagcagtgaacatttactaggagatatatataatacacattctaagtaactattgtccttgttcgctttctagctatcttaggaaggactttgatcacaaacttcgtctctttgtccttaatctcatttcatcatcgcctctgccctcttcctcctaagttacttgtttccttacatctcttctaatttatctaatttcgtttcatggcagtggtatttttccttccagaaatagtaataatgaaactttctcttcgaactgaaaccatcaggaagagttaaaatccagaatcctttttaaatttatttttggtagtttaatgaagataaggcaaaaattttaaatgcatttaatcttctacttgaccagctaactacctttaacattttggtgcatttccttccaacacatgcacacacacacacccctctttatatagatattttgataaaaaattaaatcatacctttgtttaatattgttattattatgtttctgaatttttggatcctgtatcagatgcctaataaacactttacagaatgacatttctattaataatgatttgcaaaattgataaaatcttttgaattaaacttggtaaatatcattttatttatatcaaggttgttcagtggaatgcaatgttggtctttctattagataataattttattcctttcatttaagcaagagagcatgtggaacttgacacccctgtgcagaagaaaagtgtcttttgcttcaaccctatattatttaattttgcagcaatgtttacagtgcttgtcatatcttgtaaaataagaaaatgaattatgcatgaatacaagaagaaattactaaatatgtcaacctttccagaaaactaggaaaatgcacacctcaaaaggctaattaacctttctatttcccaaattcagcatgtcctaaattaccatacaacaaggagacaagcccttctttctactttgccagtgagttgggttttttatactaattttaattgaacagtaaaacactttttaaagaatacatgttaagggagtagacttgttgagcaatatttttcttgtgccagacaaaatcattaaaaatatgtatatctgaaaataattgagtttttaaaaaggaaatataacccagcttaagaaagctggagttgatgtaaaaattgagttgtttcagaaattaatttttgcataccaagcaaacatgtgactattttggaaatgcctgatactttccttgttcagagaaactttccccaaacaaccttttttttttttttttttaaacaaaacaagtgcaagcttaaaaattagggtttttttaatatcctgataagaaaaagaatcacaatgatttttaattgaagagaattgaaatataggggagatatggttcagtattttcagtctttgcatgactacaggttttaaatattcaggtagcagacacttcacagatgtcttgagcttaagcaggaaagcatgaccaagcacaactacctgagattatctttggcactaccagccttttcttaccaccagtggataggtaaatgattgctcctaaatggagaaagtctgagcagggatttcttttggaaatgaaccagtaaggtgtgttttctctatttgtagggcagtttttaaataaggcttattcacggacttttggtatttggataggaaagttactaacttgcagaaatcctttagaaatgtataaaagtataatatgtgtcaatttatgtaaaatcctatattttaggggatagtgaggattaaaattttatgttggacactacattttaaatgattttaggatgactcagtgtgtcagtctactagatgccaaattttaaaaagcatttagaaaacattttgacttaaattttcattaattgtgccttgacttggtatccaaaaataagtgtgtacatattatttatttggtgctaagaaatgttaacaaatttaatcctttaatagatgctctttaaaaaggagtcttgctgtatatatgactgttaaaaggaaactctgtatgtgatatagtatgtaaaagacagtatcggtgcctttattatgttctccagttgaggtctcaaatgtagttatcctcaccatcttactgtctctgttggtagttttggagtcagtttcctggtaagtagctaaaaggtccttaatcatcatacctaaacattaactgtcttagctcaacttttcctaaaagggagtattagtactttttaaaagaaactaacagtgagactattatttataattgaatttgttgcttcatacccttattcccacccccttgtacgaattttgtcctggtttgttcggtctagttgcctttcactccctctttaatgagtacctttatttccttttcttctgactttaacatcagatttaaaagttgggaaattttgttgtgtttcaattggaaagttttaccatgctggcaatctctcatgacttgtgtgtccaaggtcaaaaatgacaaaacgtagttacaaattaaacccatagccttgtggactaaattgtcttcagtaagatcatggcttaggaaactattttggggctgtggttagtgttttgaggaactgacaaatcacataattaggagttttaaactttaatgtcaaggaacatggtgagtgggaaatttctgggatcagttctgacccccccaaaattgttatttgtttgattagtttgccctaattcagattttgtgaaggcaagttttatgcatagaagtttgatgaatagctaaatcagaattattaggaaaaatcactttatttttaacctctctggaatctttagttaaattaatgagcagttataataaaagcagttaaatgatatagacttagctctagaaagcacaatttactgcctttcactctccacttccccctttccctaattctcttagattttttttccctcatttactctgtcttggttcttttcttttgtctttctccccttccaacctttcccccaagcggtttggttttttggtttttttttgtttttttttttgtttttttttttttggctgccccacagcatatggaattcccaggtcagggatcagatccaagccgtagttgtgacctccaccacagctgtggcaatgagggatccttaacccactgagccaggccagggatcaaacctgtgtccagcactccagagacaccactgatcctgttgtgctacagcaggaattccctatccctcctgttccacctttctttgtctcgtacttaatgggactttcaaggcatcaaactatatttttgttgttaataatattaaagtataggttccacattttggagttcctgccatggcacaacaggatcattggcctcttgggagctctgggacacaggttcgatgccaggtctggcaccgttgggttaaagatctggtgttgctacagctgcggctgaggttgcaacttaaacttggaatctgatccctggcctgggaactccttgtgccacagggtggccaaaaaagaaaaaaaaaaaaattccgcatttttcctaggtaacaactcagttttcatatgtgaagggggaaaagaattcccggatcaggtacttgcttagccgacctgttttaagcaaggtgatgaaaaaggaagatatttctaatcaaatatccttacagtttatttgcagcttataatgtatgtttatatttgtttatttttttcttatgatgcattgtagtttactggtgtttgggtagggaagggatggttttctaaaaacaaaagcctatgtagctgcattcagcttggatttcttaagtatttgtgctatgaatgcaaatgaagtatagactagaatattctatggcctttcggcattggtaaactatcacagaaatgcctttttaaaatgcacagtagaaagtacatctttaattttcagatttcaggattttaacatttttctaattgatgagtaacaattatgagacttcatgggcataatctctttgtgatgttaatgcttttttgtgtgtgaaaattaataaaattgcacccagctagagtttattattgttactttttatttccttataccttgtttaaaagataattaaaagtgaaatttaaaactttttagtaaaaaattttgagtaaataaggttaaataaatagaaactttgggattctatgctctgtccttatgaaacctcataaatagaatttggatttgggaattgctttcccctagacagacttattacaaatgaaacatttgagaatttatggaagggacgatttttttgtttgtttttgttttttgtctttagggccacactcgcggcatatggaggttcccagtccaggggttcagtcagagctgcagctgccagcctacaccagagccacagcaatgcgggatccgcgccacatccacaacccacaccacagctcacagcaacactgatcgaggccagggatcaaccagcctcatggttcctagttggattcgtcaaccactgagccgcaatgggaactcggtatggtggggagggtgttaatgctaatggtttgaaaataagggatcatgagtgactctagacatcgctatcctatagaactttctgtgaggatggaaatgtgccacaaattgttcaatctaatcagtagcccctagctgcatgtacctgttctaattatttaaaaataaatttgacaataaatgtaagatttttacaagaacaaaggtacaaagtttatgtcaagtctttttttttttttttttttggtctttttgccatttcttgggccgctcctgcatcatatggaggttcccaggctaggggtctaatcagagctgtagctgccagcctacgccagaggcatagcaacgcggaatccgagccgcgtctgcgacctacaccacacacagctcacggcaacaccagatcgttaacccactgagcaaggccaaggatcaaacccacaacctcatggtttctagtcgtattcgttaaccactgtgccatgacgggaactcctatgtcaagtcttctagactaagtcagtgcctagataatttggagggaatcttgaagttaatggtgttaaagaatagccttttaataagccaatgaattaggggaaaagcactgactgctttcatagattcatggaactgtgaagctaaagaaagtagttattagtacattattttgcccacatcccagaaaacagtcacctacttcttaaaaaacacccagggaatacattgtcaattttccttgttaatatgtttcagtgtatgttaactgttagagttaggggaatttccctgtgtataaacaaaagtgttttgtttaatccagtctgggtgttaacataatcttaatgccccccgtggtattggcagtggatgcaccggtgatcctagcactggctctgcttcacccttccctctctgaaggataaatatgcagttcgggaggtgaccactttggctgaaatgtggtggctcttggccctacaatgtcaagcattatagaattgtttcatgtgtataacattgcataacatttacatgggatacactcagaatcattaatgctggtgaatctcagaaaccttgccttttagactgctggattagggtacctgattccaaagtggtgtctgcttctccccatcagcctcctatatgtatctgctaacacgtcatatgaagaacatgaggaactattttggagcagtttctgtgtatgggcctatcctgtcagggtttttagaattaatttgagagaaggccaaaagtcatatgctgacttccaagagataatgtctcattgccacatcagtttgctgtcagcagtcattgggaacagtgaacccatcttctgcttctgattcttttttttttttttttgtctttttgccttttcttgagccactcctgcggcatatggaggttcccaggctaaggggctaattggagctgtagccactggcctatgccagagccacagcaacatgagatccgagccgtgtctgtgacctacaccacagctcacggcaatgccagatccgtaacccactgagcaaggccagggatcgaacccgcaacctcatggttcctagtcgaattcgttaaccactgcaccaccacgggaacgccgcttctgattcttaaattgctcttttagaagatgtaaacaaatgagtttatacctggtttccctgttttgtgccaaaatatgatctgtgctgagattcacaaaaaattggctttgggttcttatctttaatgaacatatttttactaaaactagcccatcatatttcttttgaggttactctggctagtgaaattctttctaaaggctggaatgctttgaagggagttagtttttctacagtagtttaggtaatcctatttactagattttataaagcaaagatgaaagatccttgagcaaggaagcccagggagcaaactgagttgcttctgctatcagctgagagagattgtggtcatttggccctgaagatagagccctgaccttgccacacaccttatccagccccttactccagctttggtaaaaatctgtgcccacagatcactgtgccagctgcagggcagtatcatggtgaggttagccagatgatggccttgacctaaagtatgtgtatgtgtgcgattgaatagttctgtttatgcttttaagctgccttttcacaaaaacccagtgactcttttaaaagtaaattaaagctaattagattttgatataatgtgtacagctgtgttaatgtgaataaaattctagtctggttggtaagcagtaacttcacatttattttttcaagaaatggatggtttaaatggagttggatatagagattggcattgagcatcagaacagctcagttgatcaactgagagttgtcaaggcatagaggagtgatcaagatcatcacacacgtctgttatacacactcctctttctttcactttagtttccactggctcccttgctcaacagtatgcgcaccctaatgctaccctgcacccacatactccacatcctcagccttcagctactcccactggacagcagcagaaccagcatggtggaagccatcctgcacccagtcctgttcaggtaaggaggaactcagaggtcttcaccagagcttcctcataatatttgctgagtgtttttttagtgtcagacaagatgctgggtaccacgtgatcaaaatacctagcagcgtatagctttgcaggctgcgtccctagggtttaagtcacatattgagaataaggtgattggttaagttctggaagcttaccaacactgaaaaatctaatttaacataaagtaaggaatttgcttgggactttttaaaaatttaattcctaatgtttatatgatgaggtgtggggttggttttttgggggttttttttgtttgtttgttgtttttcttgttagcttttgtaatcatgtttgtttgtttgtttttgcttctttttttcagggccgcaccttggcatatggaagttcccagcctgggggttgaatcggagctgcagctgccagcctaccacagcaatgccaggtctaagccacatctgtgacctacatcacagctcatggcaacacaagatccttaatcctcggagcaaggccagggattgaacctgcatcctcatggatcctaattgttacttctgagtcacaatccaaactcctatcatgttgttagcaggacacttagggagctctttgatatggatcagttccctggggcaatagtcttattttaccaccacttggttgagggagtgtaggctgagaatcaggcttttcccccccagaaagggatgtctctgagaggcctctcaccccagcctgctcttaccactctgtactttctcttgtacttgccattgcccctccttttataaggatgggcctgagtggagcctgttttcatgtgtaaaactcagctttgtgtgtgacgcttaactgcttttctttaaagaaagtgattttctcaagtcttttgtcattttgcagcaccatcagcaccaggctgcccaggctctccatctggccagtccacaacagcagtcagccatttaccatgcagggctcgctccaaccccaccttccatgacacctgcctccaatacgcagtcgccacagaatagcttcccaacagcacaacagactgtcttcacgatccatccttctcatgttcagccggcatacaccaatccaccccacatggcccatgtacctcaggtaaacctgctttagccaactttctgtgaagaccaagtagaatatgaaggttatcagataaacagcaaagagccagatgctcttcaagctaggaaaccttgtgtgtgataccatttgcttgtctcccttttcctgctcaaatacatgtgatctggccctaaatgaatgtttgtgtggctttgtaatgggatcagtgaagttgctaattagtcagtcttttaacatttctcaattgagactttaaaaatatctttgactctggaatgcaacttagttcttttccttgctgtgtctgctttgttatgtttatataacttcattgttatatatacgtatatatacatatattctttctctctgtctttctctctgtctctctctctccctctctccccttcccccccccaaccccttctcatacacacacacagacacacaagtctggtaaagaagatgggatttcacaaattctcaactctgaggtgattaccctggtcctgtccgcttgaatgttagtcacatgagttccagagaaatctttccacttgttttccctggttgttcatacatctgctttgaccatatgttgtacttcttgaaagggcttggccttgtacattggtgcagtgtaacttgaagctggaagctcccaggtgttgttcccatttttcttaaagagcagccctggaagcactttggagctcacctccagtgtaagcttgtaaaggttgaaaggtgtgttttctgtctgcattagctgctgacaaaagtccaatgcaatccagggccaagttggattgtcttaatgaggagaaggagctgcactgaagttgggctctaatactgtcctttgatgccctccctggagctgttaagggtgaatcggctgtatttgatgtctctttttgctgctttcataacagaactctcttaggcgggtctaagctagactgcctcactgaactctgtttcctgtcaagcaatgcaccactgaggctctggcatggtgggggctgaagatgttgctcagttggagctaaatctcagaaggcgaccttgtaactagaatcccacagctctgggaagttgggggcgtcctccccagcaaatgtgtagggtctatagtgtggactgcagtggatgatttgcttttgatggtggggagggagccagtttagtcaggtgtgggccagcatggtttggctgaatcaggagcttcatgagacctgggggcctgtcgatggctagcagaggctggtggctaagtagttatgtgaatttacatgtaagctggggttcctaaaacctcacttttgtgtttttgtgctgaaagagcaaaaaggttaacatttacagggaagcccaggcatgtcctgggtccatttgaagagttagaacagcatttcatttaaggcttaccgtggtctagaacagtgcacagtatgggaggcaggaaacgagggcttttcctggttctgccaaatccctgcagagctgggatccagctgtttgggctgactaaaaacctttccatcttgacagtgagaccaggctgaactcactatcacttggtacagggacactgggctggcccagataatttcagatcacccctccccacctcacgggagcctttaactgcaacccctgctgctttagcagcatatctttcagcagagtcaaggggcctgaggttctctttctcactgccgactcattcttcactgaggtgtgctggtgagcagtcaagaagcagaaggggaggagccaacaaagagaacagaagataacagcccatttgttatataataatctgcttccttacatgaaagggatgttacctgtaaaagtatttcaggccccacctggaagccagattctaaagcatcattgcatctaaccttctactgagttgagaaagctgcccttggatcggggtcttatcttcgtgaagaccttgccccatacctagagtccagtcatcagaaatgttgaaggctaggacattgcagccctgacttttacccaggctcctggggtgcctgctccctcagccttgcaggctctgccaaagggtgaaacatgtctttaggtcagttgatgatccactagggaatgtccccagaggaaaaaaagggccctgagggctgaaccactgttgccctttcctgagagccctagcccactgaaaggaactcagttgacatgttgtttaagctggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccttatatgacgcacccttcaggtgaggcgtgtgtgtgcaggggccgccgggcaccccaaagcattctgctcgcacaggtcaaatggcaggcagggccagcgcttcaagccccgcatctgagaactagcaagacccgtcagtgtgcacagtagggactgtgatgatcagctcagtatcaggtgtgaggcttccgagagcccagtctgtgtgtgttctgatggtatacaggatttggcttgatgagaagcagcagcagcagcattctgtgtagctgatgcatgcttaggactcagttggccttccttgttatcataggatggacagggcagtgttttccttcctgagtcccaacagtctgacatgtggggggttaccaccatggcagagtttgattgtagctctggagacaactactgatgagaaagtgctgtgtatggattggttttgagtatagtattagctccagtctattccctgctagggagagaatgcccgtgattgtgctctaatacttgatggctgccatggcgatatttcagtctaacctgttattctgaaagcaattactggtgcttggctatttttggggagggggtatgttaaggcctttttttgtaccccgtgagcaacaactcttctgggagttttatctgaagtggtttatgtctgactggtttgtttctacccacccacctacctctccccctttggtacagatgtgggggtgggggggtggtaaagagaattgcattttttgagtcttattcagctagcacaaggatagttaacagtcatgtgctgcagattcactaggcttaatgtgtggtgttgccagttttctgtttaaatattcacttttcttttttacagtacaagcccaccaccaacagcagttgtaaggctgccctggaggaaccgaaaggccaaattccctcctcccttctactgcttctaccaactggaagcacagaaaactagaatttcatttattttctttttaaaaaattatatgttgatttcttgtaacatccaataggaatgctaacagttcacttgcagtggaagatatttggaccgagtagaggtatttaggaacttgtgggctgttccataattccatacgctgtttctgagtcccgcaagtaccccagctctgcttgctgaaactggaagttatttatttttaatgacccgtgaaagtcatgaacacatcagctagcaaaagaagtaacaagagtgattcttgctgctattaccgctttaaaaaaaaaaaaaaatcaagacttggaacgcccttttactaaacttgacaaaggttcagtaaattcttaccgtcaaactgacggattattatttataaatcaagtttgatgaagtgatcactgtctacagtggttcaacttttaagttaaaggaaaacttttactttgtagataatataaaataaaaactttaaaaaaaattaaaaaataaaaaaagttttaaaaactgataccaagttaatgtgtgtttgtatgagctctttccattataggatactgagtatctgagcagaagggctgactctgcttcttaataccctggaaggttggctgtcaaatgatttttcttcttcacctttagttctggttcaaggtatctctagaaaaagacaagactgagatattctgttggtggatagaggtctgcttcagaaggagaaaggctggccagagttgggcagcactgaaattccacgtcctcagcctgccactgattctgtaagctttctttttaatatctcctgaaccaaatgagtgctagaagttgtcctaattcaggcatcagtctgttttaccagtagggggcaggagacagacacacacacaaattgtaataagtatagagggctgaaaatatgtagccatgtacaaagctaggaaggggacaaacagggaaaaccaagtactttgcagagagcatagttattatagagactttaaatactgtggcaacaagtcaggattctgaaaatttccttttaattcacatgtagcagtttgtacattatagcaaaatttgcattcttcaagaataagttacttatacagtacatatacaatacataaaaatttgccaaataccttctgcctataagatgaatccattttctgttttgtcattacaatatgctgcttattccagctaaacactggatgtcagatgtgtccttgttaagaggcagtggataataaactatcaagttcctctagcctgtgggagatattagcgctcacatttgcaataagagacttagccctcaacagtagcatgaaggaatcacaggcaacccttagggaagggttctcaaggccttgattttaggttaagaaactgttatgtaaaaatagtgttctctggcttaagattttaataattgctattcctttttcctacacggtccagaaatgatcaaaggcagaagatttataccagataaagccatatggattgctggtctaaaattcaaggcaggttagttgacttaattctttggtgctggtgactgttagtttgtaaaagttcattaaagtcggatgaaggaagggatgatgatgggagcagtcaaagctgtccttgtctgtaactagagataaccagagggcttactgtcctttggcactcagagcctgggctctcagtggaggctgctggcttggcttcttgctgccagcagtggtcacactgggactggaaggagggtgggggaatgtgctatgactgtggtgggctgattgcagccatcagggtagctgcctcactgcctgtgaggatatcaagcctaggaacccattgctccccccacctccagctctgctctagcagaaggcattggcttagtgtcacttcttcccaggccatgagggagctttttgtcagaaggtatttgagctgtcctggtaactcaaacacatttagaaatgtttttcttctctgtgaacattttacactgaagcaatctggaagttgttgactcggtcacagagtttgagcttgcactttgtagccagtaggacagaggtgcttgcttgctgtgcctggcttgcctctccgcactacctgagaactcgatgacaagaggctaagaagtgagtgccgctgtggcttgaggaggtcatatcccagatgtttgtttacccttctgaggggagggagggaacttacttatttgattcattgtctacctcgccctttgcctgtgcagacaaggggaaaaactataccagtgataagtcagcattgactttctttgagaaatccaaaatagtgcttactcctggctcacattttgcttttagcattccttattcacagagacctacttgatatgtggacagtgaaggaaagacaggtgaccccaatgcagatcagggttggatctgctttaccatctctgaaaacatccaggagtgtgggttttaaagtgatgggagggagaggtggctgctgaccttcttgcccctcctaaagcctgacctctcacctcttagtgtacagagaatgaatggctggagggaacagaccaaaccctcaccccagaaataggcagtttagttcaggccaaggtttaaatttagcctttgattgaagtatctataaatgttaagctgtgctgaactcttggtttcctagaagccactttggtcagcctggcggctgtactgaatggctctgctggcacccaggagcagctgactccattgggtcactgcttcccttgtttccaagcctctgcatgaaagttctgggaggagccagcctcctatcaattgtatcatttgtgaaaggcaagtatagatggagatccaactgcagaacctccctggatgttgagggtatgtgtgcctatgtatgtatacacgcacacacgttcttcatcacatgaggcagtaaccagctagaacagaacagtaattgcgagctgttaaaggattttctcattagctgtggcaccagattcccagcttccattttggctcaagaatgagcttaaaactttgtgggataatttaatacactttcagatgcttggaggctctgagccagccctgttggccaagagtttactaggaagggcccagcagcccttctttcctttttgcttgccccttccttacctctcagtttaactctcgctgtaaagctactataaaccagaatcgttttttattcataaggcaccagggtggaactattccttgccaccctcctatttcagtaattgcctgaatttccctgaaagagtgacacgctttttacttctctacatttaggaaggacagtggcttctcaggaacaggtgactgttctttggaggcatactagacaaggaagccagtcaaggaaggtttgcatagctatctctgactacaaaaatcgcatgggtattaattcagacagtgcaatgaaataagcaatggtttaatttttgaaacctgaatcctttgaaaagttaatttgaggtaaaaatgtttaaaatcattttgatatttagcttgtccatctgccagagctttgtcctaaaaccgagtcaaagcaggataagtgtggtcacctgtggcatgggtacatcagacctgccacgtggactgaagctacaatgggaaacctataggagaagccagggcttgttagtgttttgggcttcctgatgccccccacccaaagtagaaagtctgtcagctgtgacagtgtcagtgaaaaatagaacaagtttccactgccaactcgggccctcaccctactacctcctccaaaactgatggggactggtcctgggaaccccgggcaggagctggtggcatccgtgaacaagaactacatctgtaaacaataggagacagtcaagtgagaatgaaacttataggaggccctttaacaggcctaatagaagggtcacatccaaactggaatcaacagttaacagtgtcccttaaatctctctctggaaggaaggaaagaaaattacattcacaagttcatgtctctgcttgcttatgttcctctggggcatctgggattcctcccagcctgtcagagaggtgtgtactgattgtctatggcccgcaggtggctccgggaggaggagtccatttcatagtctgagtcccgggctcgactggcaggctcaggctccaggtgcctcaggctgctggccagttcctcaggcgaaggcaccaggtggaagatctgctctgggggagaggatcggcctgggagaccctctgggccgagccccctcggacagccagaagcactaaggtggggaaggcccagctctgaatcccagcgagagagggagaaagggaacaggacggcattggaggaacctggggggaaaagtgaccaagagagaaaccactgtcagtcttaacagagcaggaccaagtgttggaaagacacaaaatgaggtctctgcctccctgagtttgcagtgagctttcaccctctacccggttgccagtgccaccgccccatttaccaaggggcattagggtcacacctggtggctgggagacaactaccacgtagctggatagccggacgtcacaggcggcaccgcactcgagtgggatgggtgaacgctggaagtggtggagcatgtgcatgaccgaggggaagtggaggtgttgtactcggcactggccccgctcagtcagtgacaggcgcaggtgctgcaggaagaggatggccggggctcaggcattgacccctaagggccttgaaaatgaagagggtgaagccctccaccccacctcaccctgtaccttggctatgccctggaagttgaatgtgagcacatattccccacgcctcgtctcactctgccggaccaggaacactccgtgagcatcaggaccctgcagctgaaccagctgtgctgccttcacccgggagatggggccatggaaccaggggtagcaggacaggaaatgatctgttttctggcaggctgggtctagcaaccccccaggagaagcacctggcagaaaagaagttacgtggtggtgaccctttgttgggtaccttatgtcctgggctagggctgggatccaacgttactggaggaaaaaggccctgaccccctcaccttggttcagggaatctgtgcttccccttggagagttaaacgtgctgggctctaaggctgaggatatgtgcgtctctgggtctgtgttctccagtctgctggagaagagtctggggttaaggatctgggtaggtcagaagtagcagtaaaagctgcgccaggaggggggccctagggtctggggcctcacccttggcctgtgcactcccgaagctcagccatccatgaattcagctgctgctcatctccaacctcaaagatgatgtctgtccggtccttcacctggcaaggagaaaggaacagctatgtgagaccctcaaggtctgtctataccgcactctccttccccccaccctgagtgtggaaagctgtctctcaccttcagcacaaaggtgtagaggttgtcgggcatctcgagacgtgtgcatcgccgaatctcctggatgctagaacaggctgcttgtagcttgggctttgaactctaggagaccaagggagacattcaaggcttgtcccactgaccctttgatcacccaggcctctgctcttttccgcagtctctccaggggcctagcttgctgagcacatgtgagtgatgcatggagtggtgcgagctcaggtaccctggggatggagtgggtgcccgcgttctcgcttgcagaaggtgtactcgcacgcgcgcgcgcacacacacacacacactgagctccccagaaacatttgggctaagggccaatctcggcttcacctagatctgtagacattccagctctgacaggtatttgctggctgaaatctttctcttcccactgggggagcaaaactccccaatccctaacctggccagtcacactggctgctgactccttcatcccagcaaacccagagagcagacatgaggctatccaaccccaggtccctctgtggtgctggctgactgccaggggccccaggcctttaccttgcctttagctccactcctcccctccactggctgtccactagcacaggtctctcccagcctaacagcagccctaggaagcagatactatcaccgcaacttaaaaagaagaaacttggagttcttattgtggcttagtgggttaagaaccccaccctgtctccttgaggatgtgggttcgatccctggccttgcccagtgggttaaggatccagcactgccgcaaactgtggcataggttgtagatgtagcttggatccagtgttgctgtggtcatggcataggtcggcagctgcagctccaatgcgactcctagcctaggaccttccatatgccaccggtgtggccctaaaaagaataaaaatgaaaagaagaaactgaaattttgaaagtgaagtcatttgcctgaggaagtggacctctctccacagagcctagaatctcaagctcccaaacacacctaactaacctgttttgccttcaggtgttaggaccagcagacatggatttggctgtggggtggggattggcagagcagcttagcttatggactcggtgtttctgccagtgtgcccttttgtctggcttggctggccccagttacaaccagctggaaagccacacaaaaccttgggctctggagcctcccacaacatacagcacacacagggctcagagtgggtcggggtgaccctctacccttttaccagcaaaaggctcctgactgaacctggctggagcatgggctgaccctgcagatgtctgttccagggtgcaggaagtttttgcagaaaggagatcacactttaccacccccatctccacatcctcttgtgataaggctgatgagattgtttccctgggatcaggagatgattgatggcttccagcagagaccaaaagaagatgaacatggaggaaggagcaagatgcggcgagtggacagaggagacccaactccaatggggcccttctccctctaacagctcttttccttggagccaggagacagcaaggtgcccctggaaagtgccacaacccccgcctgccaagccagcaccagatggggagagggaacaaaagtgagttccaggcacaatggcttttctggtccagaccccacccacccaccccgggcaggtgtcggagctcctagtcctgccccggttgtgggacacagcagtctggggagagcaactctggttacgagcatggagaagctgcacaactagtaaatcccaaccctgagtgacctgcaccagccgggacattagcacctttcaagttcttttatgtcctccatgacccaatttctcagccttggagccatgtgagacgcagggatccctggagccttgcacggcacctacacgggcactagacgtgcctgagagcacgggaagcagagcctctgctctcctggcagctttcagtcagccagtctctcgttgtctattttctgactgcaaaatgggttaggtacagagaactaagtccttctcccacttgtgcagttggccctgccttgtccccccaaccctccccactggctcaaggcccacaggatcactgggaggaagtaggccaggctaagaggggaggccaggcctagtctccctttcagttccgctgcgggccctgggcctggcctccagtgtgggtgccaagattaagcagtaaagccactggtttcattctgaatgtggggctctctgtgccagctccacccccagcagctgaggaactgctgacctggcaggcagtgaagagaggattcccctcctcaccacggccagcctttgctgcacagatgatggtgaaactcatcctggctccccctctgcacactggctgagtgtgatacagcctctttcatctcttcacagcagcccatttgtcttgcccagagtcgcacaacccgggaggctgagcaggggctgaaccccagcctgccaaggatcagagccagtgcatctaactactgtggtgggtgggagatgccagaggctctgcccaggttggaggggtgattgagaacacagcaacagacatctctgcctttggccacagccctagctggacaatccaaagcaagatgcaggaagactgggtggagggaccagggggtgcctttctagctgggtgctgtgacaggacagagctgggcttgaacagcagccccagaaacactcggggctttaggtccacctcctttctgcaccctccctcccacctgccttgcagatccacctggccagcagttgctccctggactcacctcagagtcacacagcttgggacccaaatgaccaaactgttgcagtatttgtggtacaagcagtagactgtcaccccctacactctgcaacattcacgcctggagagctagtcccattcttagcttctagcatccaaaaagctagcttcttagagccactgtgactccagaggtaataacccatttctttctttgctgtggctaagaaacaaagacagatgtaaaccagctttgacattgtcctcaagtagggcttgtgcatttatagggctttttaattctcttacctctccaggctaaaggttcagtctagatcctgttcttgtataaccctggataagtgactcagccctctgtgccttagttttgtcatctgtaaggtagaaatatttaatagtctctctcttttcacagggttgatatggtgaatgggtgaacttttgcaagtgaaagaaatgcctgactgataaacagctgttgttaaatttccaggctggggtctgaggccagccaagatggggaaagcctgctagggtccactacagtgttgcagtgctcctgtgtcacttcagcgaaattgacacataatagaacctacctgcatacataccttaagtaagataagagggaagtaatggaatgtaattgatgttaaaataaaatgtatttcggtgtgactatatatagcacaatgaacta

SEQ ID NO: 6 - DNA, 29 bp, homo sapiens
ttaaggaggttaaagtaaaatgtgaattt

SEQ ID NO: 7 - DNA, 17 bp, ARTIFICIAL
  Oligonucleotide motif
attttactttaacctcc

SEQ ID NO: 8 - DNA, 18 bp, ARTIFICIAL
  Oligonucleotide motif
cattttactttaacctcc

SEQ ID NO: 9 - DNA, 19 bp, ARTIFICIAL
  Oligonucleotide motif
cattttactttaacctcct

SEQ ID NO: 10 - DNA, 19 bp, ARTIFICIAL
  Oligonucleotide motif
acattttactttaacctcc

SEQ ID NO: 11 - DNA, 19 bp, ARTIFICIAL
  Oligonucleotide motif
cacattttactttaacctc

SEQ ID NO: 12 - DNA, 18 bp, ARTIFICIAL
  Oligonucleotide motif
cacattttactttaacct

SEQ ID NO: 13 - DNA, 19 bp, ARTIFICIAL
  Oligonucleotide motif
tcacattttactttaacct

SEQ ID NO: 14 - DNA, 18 bp, ARTIFICIAL
  Oligonucleotide motif
tcacattttactttaacc

SEQ ID NO: 15 - DNA, 20 bp, ARTIFICIAL
  Oligonucleotide motif
tcacattttactttaacctc

SEQ ID NO: 16 - DNA, 20 bp, ARTIFICIAL
  Oligonucleotide motif
ttcacattttactttaacct

SEQ ID NO: 17 - DNA, 18 bp, ARTIFICIAL
  Oligonucleotide motif
ttcacattttactttaac

SEQ ID NO: 18 - DNA, 19 bp, ARTIFICIAL
  Oligonucleotide motif
ttcacattttactttaacc

SEQ ID NO: 19 - DNA, 19 bp, ARTIFICIAL
  Oligonucleotide motif
attcacattttactttaac

SEQ ID NO: 20 - DNA, 17 bp, ARTIFICIAL
  Oligonucleotide motif
attttactttaacctcc

SEQ ID NO: 21 - DNA, 18 bp, ARTIFICIAL
  Oligonucleotide motif
cattttactttaacctcc

SEQ ID NO: 22 - DNA, 19 bp, ARTIFICIAL
  Oligonucleotide motif
cacattttactttaacctc

SEQ ID NO: 23 - DNA, 18 bp, ARTIFICIAL
  Oligonucleotide motif
cacattttactttaacct

SEQ ID NO: 24 - DNA, 19 bp, ARTIFICIAL
  Oligonucleotide motif
tcacattttactttaacct

SEQ ID NO: 25 - DNA, 18 bp, ARTIFICIAL
  Oligonucleotide motif
tcacattttactttaacc

SEQ ID NO: 26 - DNA, 20 bp, ARTIFICIAL
  Oligonucleotide motif
tcacattttactttaacctc

SEQ ID NO: 27 - DNA, 20 bp, ARTIFICIAL
  Oligonucleotide motif
ttcacattttactttaacct

SEQ ID NO: 28 - DNA, 19 bp, ARTIFICIAL
  Oligonucleotide motif
ttcacattttactttaacc

SEQ ID NO: 29 - DNA, 20 bp, ARTIFICIAL
  Oligonucleotide motif
attcacattttactttaacc

SEQ ID NO: 30 - DNA, 17 bp, ARTIFICIAL
  Oligonucleotide motif
attttactttaacctcc

SEQ ID NO: 31 - DNA, 19 bp, ARTIFICIAL
  Oligonucleotide motif
acattttactttaacctcc

SEQ ID NO: 32 - DNA, 19 bp, ARTIFICIAL
  Oligonucleotide motif
cacattttactttaacctc

SEQ ID NO: 33 - DNA, 18 bp, ARTIFICIAL
  Oligonucleotide motif
tcacattttactttaacc

SEQ ID NO: 34 - DNA, 19 bp, ARTIFICIAL
  Oligonucleotide motif
ttcacattttactttaacc

SEQ ID NO: 35 - DNA, 20 bp, ARTIFICIAL
  Oligonucleotide motif
attcacattttactttaacc

SEQ ID NO: 36 - DNA, 17 bp, ARTIFICIAL
  Oligonucleotide motif
tccattaactactcttt

SEQ ID NO: 37 - DNA, 20 bp, ARTIFICIAL
  Oligonucleotide motif
gtgggatacaaattgtaccg

SEQ ID NO: 38 - DNA, 20 bp, artificial
  primer or probe sequence
ccagcttactccacgcaata

SEQ ID NO: 39 - DNA, 23 bp, artificial
  primer or probe sequence
catgaggatgctgagactgataa

SEQ ID NO: 40 - DNA, 24 bp, artificial
  primer or probe sequence
tcctcagcagttcccaaatcagcc

SEQ ID NO: 41 - DNA, 19 bp, artificial
  primer or probe sequence
agctgttgccatgcctatt

SEQ ID NO: 42 - DNA, 22 bp, artificial
  primer or probe sequence
ggagagttctgcctttgatctt

SEQ ID NO: 43 - DNA, 24 bp, artificial
  primer or probe sequence
tgctagtcctgcatcgaacagagc

SEQ ID NO: 44 - DNA, 20 bp, artificial
  primer or probe sequence
ttcaacccacgttccttctc

SEQ ID NO: 45 - DNA, 20 bp, artificial
  primer or probe sequence
gctgttgatgacccaccata

SEQ ID NO: 46 - DNA, 22 bp, artificial
  primer or probe sequence
aacttcacctcggcctcaagca

SEQ ID NO: 47 - DNA, 22 bp, artificial
  primer or probe sequence
ctccagctcctgtctctactat

SEQ ID NO: 48 - DNA, 21 bp, artificial
  primer or probe sequence
actctggatttcgaggatgtc

SEQ ID NO: 49 - DNA, 24 bp, artificial
  primer or probe sequence
ttcagaagggcctccaaggatgtc

The invention claimed is:

1. An antisense oligonucleotide of formula TCAcAttt-tactttaacCTC (SEQ ID NO 15_4) wherein capital letters are beta-D-oxy LNA nucleosides, lowercase letters are DNA nucleosides, all LNA C are 5-methyl cytosine, all internucleoside linkages are phosphorothioate internucleoside linkages.

2. The antisense oligonucleotide of claim 1, wherein the antisense oligonucleotide is of formula

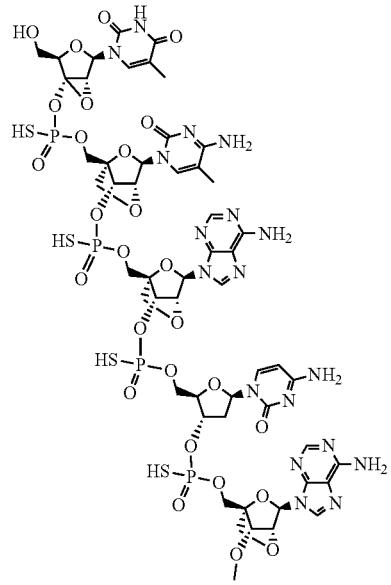

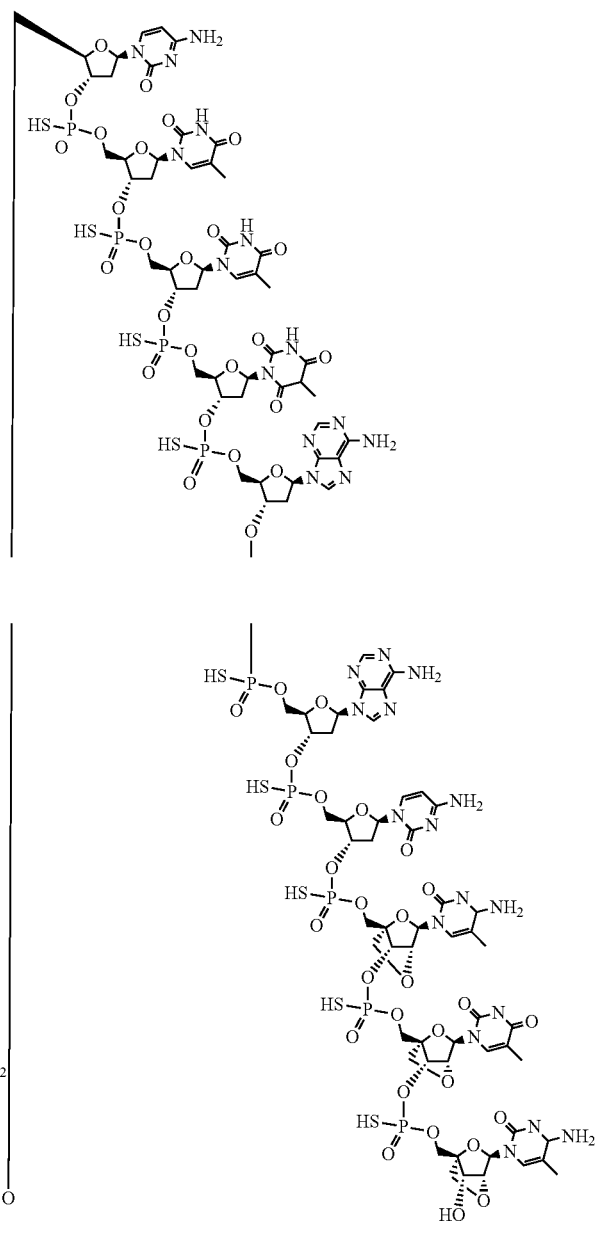

or a pharmaceutically acceptable salt thereof.

3. The antisense oligonucleotide according to claim 1 or claim 2, wherein the antisense oligonucleotide is in the form of a pharmaceutically acceptable salt.

4. The antisense oligonucleotide according to claim 1 or claim 2, wherein the antisense oligonucleotide is in the form of a pharmaceutically acceptable sodium salt.

5. The antisense oligonucleotide according to claim 1 or claim 2, wherein the antisense oligonucleotide is in the form of a pharmaceutically acceptable potassium salt.

6. A conjugate comprising the antisense oligonucleotide according to claim 1, and at least one conjugate moiety covalently attached to said oligonucleotide.

7. A pharmaceutical composition comprising the antisense oligonucleotide of claim 1 and a pharmaceutically acceptable diluent, solvent, carrier, salt and/or adjuvant.

8. The pharmaceutical composition according to claim 7, wherein the composition comprises a pharmaceutically acceptable diluent.

9. The pharmaceutical composition according to claim 8, wherein the pharmaceutically acceptable diluent is sterile phosphate buffered saline.

10. The pharmaceutical composition according to claim 7 wherein the antisense oligonucleotide is used in the pharmaceutically acceptable diluent at a concentration of 1-100 mg/mL solution.

11. The pharmaceutical composition according to claim 10, wherein the antisense oligonucleotide is used in the pharmaceutically acceptable diluent at a concentration of 2-30 mg/mL.

12. An in vivo or in vitro method for modulating ATXN2 expression in a target cell which is expressing ATXN2, said method comprising administering an antisense oligonucleotide of claim 1 or claim 2 in an effective amount to said cell.

13. A method for treating a patient for a neurodegenerative disease selected from the group consisting of spinocerebellar ataxia type 2 (SCA2), amyotrophic lateral sclerosis (ALS), Alzheimer's, frontotemporal dementia (FTD), parkinsonism and conditions with TDP-43 proteinopathies, comprising administering a therapeutically effective amount of the antisense oligonucleotide of claim 1 or claim 2 to the patient.

14. The method of claim 13, wherein the neurodegenerative disease is spinocerebellar ataxia type 2 (SCA2).

\* \* \* \* \*